United States Patent
Kudo et al.

(10) Patent No.: US 10,806,787 B2
(45) Date of Patent: Oct. 20, 2020

(54) ANTICANCER AGENTS OR ANTIMETASTATIC AGENTS USING FSTL1 AND COMBINATION DRUG THEREOF

(71) Applicant: PHARMA FOODS INTERNATIONAL CO., LTD., Kyoto (JP)

(72) Inventors: Chie Kudo, Tokyo (JP); Masayoshi Toyoura, Kyoto (JP); Akiko Ishida, Kyoto (JP); Yuji Shoya, Kyoto (JP); Chihiro Yamazaki, Kyoto (JP)

(73) Assignee: PHARMA FOODS INTERNATIONAL CO., LTD., Kyoto (JP)

( * ) Notice: Subject to any disclaimer, the term of this patent is extended or adjusted under 35 U.S.C. 154(b) by 15 days.

(21) Appl. No.: 15/550,461

(22) PCT Filed: Feb. 16, 2016

(86) PCT No.: PCT/JP2016/054362
§ 371 (c)(1),
(2) Date: Aug. 11, 2017

(87) PCT Pub. No.: WO2016/133059
PCT Pub. Date: Aug. 25, 2016

(65) Prior Publication Data
US 2018/0021429 A1    Jan. 25, 2018

(30) Foreign Application Priority Data

| Feb. 16, 2015 | (JP) | 2015-028091 |
| Feb. 16, 2015 | (JP) | 2015-028092 |
| Oct. 7, 2015 | (JP) | 2015-199695 |
| Oct. 7, 2015 | (JP) | 2015-199696 |
| Oct. 7, 2015 | (JP) | 2015-199697 |
| Oct. 7, 2015 | (JP) | 2015-199698 |

(51) Int. Cl.
| A61K 39/395 | (2006.01) |
| C07K 16/18 | (2006.01) |
| C07K 16/28 | (2006.01) |
| A61K 45/06 | (2006.01) |
| A61K 31/675 | (2006.01) |
| C12N 15/09 | (2006.01) |
| A61K 39/00 | (2006.01) |

(52) U.S. Cl.
CPC .......... *A61K 39/395* (2013.01); *A61K 31/675* (2013.01); *A61K 39/39533* (2013.01); *A61K 45/06* (2013.01); *C07K 16/18* (2013.01); *C07K 16/2818* (2013.01); *C07K 16/2827* (2013.01); *A61K 2039/505* (2013.01); *A61K 2039/507* (2013.01); *C07K 2317/23* (2013.01); *C07K 2317/24* (2013.01); *C07K 2317/33* (2013.01); *C07K 2317/34* (2013.01); *C07K 2317/622* (2013.01); *C07K 2317/76* (2013.01); *C07K 2317/92* (2013.01); *C12N 15/09* (2013.01)

(58) Field of Classification Search
CPC .................................................. A61K 39/395
USPC ........................................................ 424/133.1
See application file for complete search history.

(56) References Cited

U.S. PATENT DOCUMENTS

| 9,169,324 | B2 * | 10/2015 | Kudo ............... A61K 31/00 |
| 2007/0253962 | A1 | 11/2007 | Hirsch et al. |
| 2009/0053224 | A1 | 2/2009 | Smith et al. |
| 2010/0098701 | A1 | 4/2010 | Jure-Kunkel et al. |
| 2010/0291677 | A1 | 11/2010 | Kudo et al. |
| 2010/0330093 | A1 | 12/2010 | Rios et al. |
| 2011/0274698 | A1 | 11/2011 | Hirsch et al. |
| 2013/0115225 | A1 | 5/2013 | Kudo et al. |
| 2014/0105914 | A1 | 4/2014 | Jones et al. |

FOREIGN PATENT DOCUMENTS

| CN | 104232590 | 12/2014 |
| EP | 2 193 805 | 6/2010 |
| JP | 2011-506436 | 3/2011 |
| JP | 2011-184325 | 9/2011 |
| JP | 2012-533619 | 12/2012 |
| JP | 2014-512809 | 5/2014 |
| JP | 2014-210785 | 11/2014 |
| WO | 2007/109686 | 9/2007 |
| WO | 2009/028411 | 3/2009 |
| WO | 2013/187052 | 12/2013 |

OTHER PUBLICATIONS

International Preliminary Report on Patentability dated Aug. 31, 2017 in International Application No. PCT/JP2016/054362.
"Human Follistatin-like1/FSTL1 Antibody MAB1694: R&D Systems".
International Search Report dated May 24, 2016 in International Application No. PCT/JP2016/054362.
Yingying Dong et al., "Blocking follistatin-like 1 attenuates bleomycin-induced pulmonary fibrosis in mice", Journal of Experimental Medicine, Feb. 9, 2015, vol. 212, No. 2, p. 235-252.
Chie Kudo-Saito et al., "Targeting FSTL1 Prevents Tumor Bone Metastasis and Consequent Immune Dysfunction", Cancer Research, 2013, vol. 73, No. 20, p. 6185-6193.

(Continued)

*Primary Examiner* — Sean E Aeder
(74) *Attorney, Agent, or Firm* — Wenderoth, Lind & Ponack, L.L.P.

(57) ABSTRACT

The present invention provides an anti-FSTL1 antibody or a fragment or functional equivalent thereof, wherein the antibody recognizes an epitope in a region selected from the group consisting of amino acid positions 48 to 100, 148 to 162, 193 to 216, 205 to 228, and 272 to 289 of SEQ ID NO: 1 (amino acid sequence of human FSTL1). The present invention also provides a combination product of a FSTL1 suppressor and additional cancer treatment. It is understood that immune defect such as immunosuppression or immunodeficiency is effectively mitigated by the present invention.

19 Claims, 151 Drawing Sheets
Specification includes a Sequence Listing.

(56) References Cited

OTHER PUBLICATIONS

Chie Kudo-Saito et al., "FSTL1 promotes bone metastasis by causing immune dysfunction", OncoImmunology, 2013, vol. 2, No. 11, e26528.

Abdeljabar El Andaloussi et al., "An increase in CD4+CD25+ FOXP3+regulatory T cells in tumor-infiltrating lymphocytes of human glioblastoma multiforme[1]", Neuro-Oncology, 234-243, 2006.

Fumiko Ichihara et al., "Increased Populations of Regulatory T Cells in Peripheral Blood and Tumor-Infiltrating Lymphocytes in Patients with Gastric and Esophageal Cancers", Clinical Cancer Research, vol. 9, 4404-4408, Oct. 1, 2003.

Anna Maria Wolf et al., "Increase of Regulatory T Cells in the Peripheral Blood of Cancer Patients[1]", Clinical Cancer Research, vol. 9, 606-612, Feb. 2003.

William F. Hickey, "Leukocyte traffic in the central nervous system: the participants and their roles", Immunology, vol. 11, 1999: pp. 125-137.

Udaya K. Liyanage et al., "Prevalence of Regulatory T Cells Is Increased in Peripheral Blood and Tumor Microenvironment of Patients with Pancreas or Breast Adenocarcinoma", The Journal of Immunology, 2002; 169:2756-2761.

Tetsuro Sasada et al., "CD4$^+$CD25$^+$ Regulatory T Cells in Patients with Gastrointestinal Malignancies", Cancer Research 98, 5: 1089-1099, 2003.

Edward Y. Woo et al., "Regulatory CD4$^+$CD25$^+$ T Cells in Tumors from Patients with Early-Stage Non-Small Cell Lung Cancer and Late-Stage Ovarian Cancer", Cancer Research 61, 4766-4772, Jun. 2001.

Shimon Sakaguchi et al., "Immunologic tolerance maintained by CD25$^+$ CD4$^+$ regulatory T cells: their common role in controlling autoimmunity, tumor immunity, and transplantation tolerance", Immunological Reviews 182, 18-32, 2001.

Mary Jo Turk et al., "Multiple pathways to tumor immunity and concomitant autoimmunity", Immunological Reviews 188, 122-135, 2002.

Makoto Miyara et al., "Natural regulatory T cells: mechanisms of suppression", TRENDS in Molecular Medicine, vol. 13, No. 3, 108-116, 2007.

Partial Supplementary European Search Report dated Aug. 16, 2018 in corresponding European patent application No. 16752445.3.

Kudo et al., "Efficient Inhibition of Bone Metastasis Using an Anti-FSTL 1 Antibody", Proceedings of the 24th Annual Meeting of the Japanese Association for Metastasis Research, Aug. 6, 2015, vol. 24, p. 63, with an English translation.

* cited by examiner

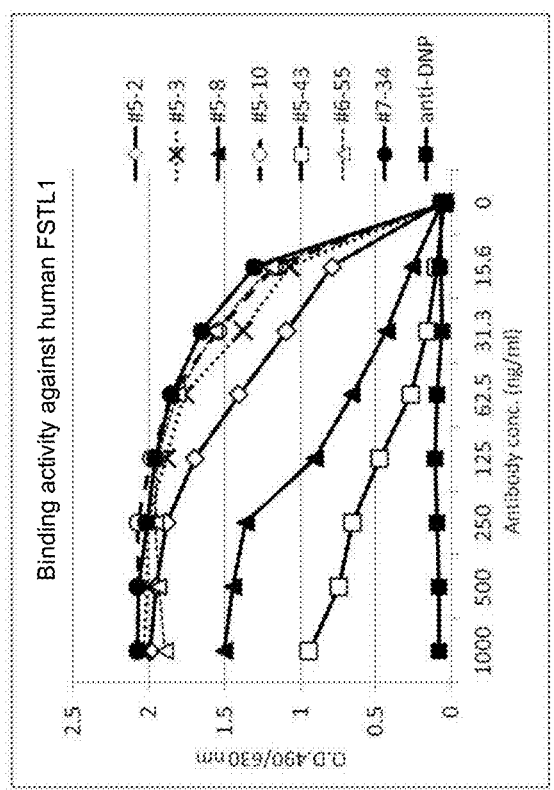
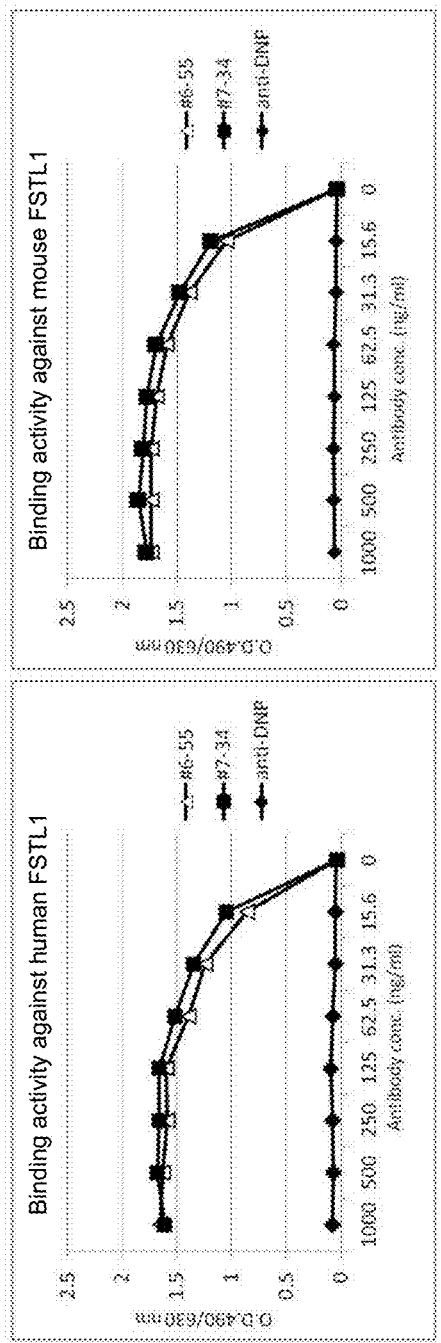
FIG. 1

FIG. 19

|       | #(6-55) | R&D |
|-------|---------|-----|
| Exp.1 | ○       | ×   |
| Exp.2 | ◎       | ×   |
| Exp.3 | ◎       | △   |

FIG. 49B

|       | #(6-55) | R&D |
|-------|---------|-----|
| Exp.1 | ○       | ×   |
| Exp.2 | ◎       | ×   |
| Exp.3 | ◎       | △   |

|       | #(6-55) | R&D |
|-------|---------|-----|
| Exp.1 | ○       | ×   |
| Exp.2 | ◎       | ×   |
| Exp.3 | ◎       | △   |

FIG. 113

|  | #(6-55) | R&D |
|---|---|---|
| Exp.1 | ○ | × |
| Exp.2 | ◎ | × |
| Exp.3 | ◎ | △ |

FIG. 126

Table 1A

ANTICANCER AGENTS OR ANTIMETASTATIC AGENTS USING FSTL1 AND COMBINATION DRUG THEREOF

TECHNICAL FIELD

The present invention relates to a drug for treatment of malignant tumor, etc.

BACKGROUND ART

Immunosuppression has been known as a cause of aggravation of cancer. The mitigation of immunosuppression reportedly leads to the effective treatment of cancer. Thus, approaches therefor are under development.

Patent Literature 1 has reported molecules associated with the mitigation of immunosuppression. Although FSTL1 has been studied to some extent (Non Patent Literatures 1 and 2), much is still unknown about its functions.

Techniques of the mitigation of immunosuppression are still evolving. Cancer patients have in vivo host immunity, which attempts to attack and eliminate cancer. On the other hand, cancer cells are known to possess a system that attempts to circumvent control of the host immunity. For example, it has been found in vitro and in vivo that immune response to cancer cells is changed by removing regulatory T cells in the presence of the cancer cells (see Non Patent Literature 3=Andaloussi and Lesniak Neuro-Oncology 8, 234-243, 2006). Regulatory T cells increase in number in stomach cancer (see Non Patent Literature 4=Ichihara et al., Clin. Cancer Res. 9, 4404-4408, 2003; and Non Patent Literature 5=Wolf et al., Clin. Cancer Res. 9, 606-612, 2003), rectal cancer (see Non Patent Literature 6=Hicky et al., Semin. Immunol. 11, 125-137, 1999), pancreatic cancer (see Non Patent Literature 7=Liyanage et al., J. Immunol. 169, 2756-2761, 2002; and Non Patent Literature 8=Sasada et al., Cancer 98, 1098-1099, 2003), lung cancer (see Non Patent Literature 9=Woo et al., Cancer Res. 61, 4766-4772, 2001), and glioma (see Non Patent Literature 3=Andaloussi and Lesniak Neuro-Oncology 8, 234-243, 2006), suggesting that the regulatory T cells are involved in the immune escape system of cancer cells. However, the mechanism underlying this is unknown, and the manner in which regulatory T cell-derived cytokines contribute remains a subject of dispute (see Non Patent Literature 3).

Deficiency in regulatory T cells causes serious autoimmune diseases (see Non Patent Literature 10=Sakaguchi et al., Immunol. Rev. 182, 18-32, 2001), suggesting that autoimmunity and cancer immunity have a common mechanism (see Non Patent Literature 11=Turk et al., Immunol. Rev. 188, 122-135, 2002). As mentioned above, regulatory T cells are known to participate not only in the immunosuppression of cancer cells but in exaggerated immune response such as autoimmunity or allergic reaction, through the suppression of immune response (see Non Patent Literature 12=Miyara and Sakaguchi Trends Mol. Med. 13, 108-116, 2007).

Against this backdrop, drugs for mitigation of immunosuppression currently under development are designed to remove some immunosuppressive cell populations, such as regulatory T cells or regulatory dendritic cells, or to inhibit their functions. Therefore, under the present circumstance, these drugs must be used in combination for modifying the whole immune system and are reportedly not much effective in actuality.

CITATION LIST

Patent Literature

[Patent Literature 1] International Publication No. WO2009/028411

Non Patent Literature

[Non Patent Literature 1] Cancer Research 73 (20); 6185-93, 2013
[Non Patent Literature 2] OncoImmunology 2: 11, e26528, 2013
[Non Patent Literature 3] Andaloussi and Lesniak Neuro-Oncology 8, 234-243, 2006
[Non Patent Literature 4] Ichihara et al. Clin.Cancer Res. 9, 4404-4408, 2003
[Non Patent Literature 5] Wolf et al. Clin.Cancer Res. 9, 606-612, 2003
[Non Patent Literature 6] Hicky et al. Semin. Immunol. 11, 125-137, 1999
[Non Patent Literature 7] Liyanage et al. J. Immunol. 169, 2756-2761, 2002
[Non Patent Literature 8] Sasada et al. Cancer 98, 1098-1099, 2003
[Non Patent Literature 9] Woo et al. Cancer Res. 61, 4766-4772, 2001
[Non Patent Literature 10] Sakaguchi et al. Immunol. Rev. 182, 18-32, 2001
[Non Patent Literature 11] Turk et al. Immunol. Rev. 188, 122-135, 2002
[Non Patent Literature 12] Miyara and Sakaguchi Trends Mol. Med. 13, 108-116, 2007

SUMMARY OF INVENTION

Solution to Problem

The present inventors have conducted diligent studies and consequently completed the present invention by finding out that: FSTL1 is a more promising target for the mitigation of immunosuppression; and the inhibition of the activity of FSTL1 is effective against the induction or growth of cancer-associated mesenchymal stem cells (MSCs) inducing immunosuppression considered to be partly responsible for the aggravation of cancer, and further against the acquirement of metastatic properties, particularly, bone metastatic properties, by cancer cells, and is remarkably effective for eliminating cancer. In the present invention, it has been found that FSTL1 can induce MSCs inducing immunosuppressive cells such as regulatory T cells, regulatory dendritic cells, tolerogenic dendritic cells, or myeloid-derived suppressor cells. Hence, it has been found that: upstream inhibition thereof may mitigate the whole mechanism of immunosuppression; and such an inhibitor is available as an effective anticancer agent. Thus, the present invention should receive attention, particularly, from the viewpoint that it is expected that cancer can be eliminated from living bodies more effectively than conventional methods by both "inhibition of MSCs inducing immune defect such as immunosuppression or immunodeficiency" and "inhibition of the metastatic properties of cancer cells".

Thus, the present invention provides the following:
(1) An anti-FSTL1 antibody or a fragment or functional equivalent thereof, wherein the antibody recognizes an epitope in a region selected from the group consisting of amino acid positions 148 to 170, 193 to 228, and 233 to 289 of SEQ ID NO: 1 (amino acid sequence of human FSTL1).

(2) The anti-FSTL1 antibody or the fragment or functional equivalent thereof according to item 1, wherein the antibody recognizes an epitope in a region selected from the group consisting of amino acid positions 148 to 162 and 233 to 289 of SEQ ID NO: 1 (amino acid sequence of human FSTL1).

(3) An anti-FSTL1 antibody or a fragment or functional equivalent thereof, wherein the antibody comprises the heavy chain CDR1, heavy chain CDR2, heavy chain CDR3, light chain CDR1, light chain CDR2, and light chain CDR3 of an antibody selected from the group consisting of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68).

(4) The anti-FSTL1 antibody or the fragment or functional equivalent thereof according to item 3, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68).

(5) The anti-FSTL1 antibody or the fragment or functional equivalent thereof according to item 3, wherein the antibody comprises the full-length variable regions of an antibody selected from the group consisting of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68).

(6) The anti-FSTL1 antibody or the fragment or functional equivalent thereof according to any one of items 3 to 5, wherein the antibody comprises the full-length variable regions of an antibody selected from the group consisting of antibody #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68).

(7) The anti-FSTL1 antibody or the fragment or functional equivalent thereof according to any one of items 3 to 5, wherein the antibody comprises a full-length antibody selected from the group consisting of antibody #5-2 (light chain: SEQ ID NO: 96; heavy chain: SEQ ID NO: 98), #5-3 (light chain: SEQ ID NO: 100; heavy chain: SEQ ID NO: 102), antibody #5-8 (light chain: SEQ ID NO: 104; heavy chain: SEQ ID NO: 106), #5-10 (light chain: SEQ ID NO: 108; heavy chain: SEQ ID NO: 110), #5-43 (light chain: SEQ ID NO: 112; heavy chain: SEQ ID NO: 114), #6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #8-4 (light chain: SEQ ID NO: 128; heavy chain: SEQ ID NO: 130), #8-7 (light chain: SEQ ID NO: 132; heavy chain: SEQ ID NO: 134), #8-8 (light chain: SEQ ID NO: 136; heavy chain: SEQ ID NO: 138), #7 (light chain: SEQ ID NO: 140; heavy chain: SEQ ID NO: 142), #10 (light chain: SEQ ID NO: 144; heavy chain: SEQ ID NO: 146), #13 (light chain: SEQ ID NO: 148; heavy chain: SEQ ID NO: 150), #22 (light chain: SEQ ID NO: 152; heavy chain: SEQ ID NO: 154) and #33 (light chain: SEQ ID NO: 156; heavy chain: SEQ ID NO: 158) or a humanized sequence thereof.

(8) The anti-FSTL1 antibody or the fragment or functional equivalent thereof according to any one of items 3 to 7, wherein the antibody comprises a full-length antibody selected from the group consisting of antibody #6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #7 (light chain: SEQ ID NO: 140; heavy chain: SEQ ID NO: 142), #13 (light chain: SEQ ID NO: 148; heavy chain: SEQ ID NO: 150) and #33 (light chain: SEQ ID NO: 156; heavy chain: SEQ ID NO: 158) or a humanized sequence thereof.

(9) A medicament comprising an anti-FSTL1 antibody or a fragment or functional equivalent thereof according to any one of items 1 to 8.

(10) An anticancer agent comprising an anti-FSTL1 antibody, or a fragment thereof or a functional equivalent according to any one of items 1 to 8.

(11) A therapeutic agent for metastatic malignant tumor comprising an anti-FSTL1 antibody, or a fragment thereof or a functional equivalent according to any one of items 1 to 8.

(12) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising an anti-FSTL1 antibody, or a fragment thereof or a functional equivalent according to any one of items 1 to 8.

(13) An inhibitor of metastasis of cancer cells, comprising an anti-FSTL1 antibody, or a fragment thereof or a functional equivalent according to any one of items 1 to 8.
(14) The inhibitor according to item 13, wherein the metastasis includes bone metastasis or lung metastasis.
(15) An inhibitor of enhancement of immune defect by mesenchymal stem cells (MSCs), comprising an anti-FSTL1 antibody or a fragment or functional equivalent thereof according to any one of items 1 to 8.
(16) The inhibitor according to item 15, wherein the immune defect includes immunosuppression and immunodeficiency.
(16A) The inhibitor according to item 15, wherein the immune defect includes immunosuppression.
(16B) The inhibitor according to item 15, wherein the immune defect includes immunodeficiency.
(17) The inhibitor according to item 15, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.
(18) An inhibitor of acquirement and/or enhancement of immune defect activity by or of immune-related cells, comprising an anti-FSTL1 antibody, or a fragment thereof or a functional equivalent according to any one of items 1 to 8.
(19) The inhibitor according to item 18, wherein the immune defect includes immunosuppression and immunodeficiency.
(19A) The inhibitor according to item 18, wherein the immune defect includes immunosuppression.
(19B) The inhibitor according to item 18, wherein the immune defect includes immunodeficiency.
(20) The inhibitor according to item 18, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

The present invention also provides the following:
(A1) An anti-FSTL1 antibody or a fragment or functional equivalent thereof, wherein the antibody recognizes an epitope in a region selected from the group consisting of amino acid positions 48 to 100, 148 to 162, 193 to 216, 205 to 228, and 272 to 289 of SEQ ID NO: 1 (amino acid sequence of human FSTL1).
(A2) The anti-FSTL1 antibody or the fragment or functional equivalent thereof according to item A1, wherein the antibody recognizes an epitope in a region selected from the group consisting of amino acid positions 48 to 100, 148 to 162, 205 to 228, and 272 to 289 of SEQ ID NO: 1 (amino acid sequence of human FSTL1).
(A3) The anti-FSTL1 antibody or the fragment or functional equivalent thereof according to item A1 or A2, wherein the antibody recognizes an epitope in a region selected from the group consisting of amino acid positions 148 to 162 and 205 to 228 of SEQ ID NO: 1 (amino acid sequence of human FSTL1).
(A4) An anti-FSTL1 antibody or a fragment or functional equivalent thereof, wherein the antibody comprises the heavy chain CDR1, heavy chain CDR2, heavy chain CDR3, light chain CDR1, light chain CDR2, and light chain CDR3 of an antibody selected from the group consisting of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68).
(A5) The anti-FSTL1 antibody or the fragment or functional equivalent thereof according to item A4, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68).
(A6) The anti-FSTL1 antibody or the fragment or functional equivalent thereof according to item A4 or A5, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 148; heavy chain: SEQ ID NO: 150) and #33 (light chain: SEQ ID NO: 156; heavy chain: SEQ ID NO: 158).
(A7) The anti-FSTL1 antibody or the fragment or functional equivalent thereof according to any one of items A4 to A6, wherein the antibody comprises the full-length variable regions of an antibody selected from the group consisting of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68).

(A8) The anti-FSTL1 antibody or the fragment or functional equivalent thereof according to any one of items A4 to A7, wherein the antibody comprises the full-length variable regions of an antibody selected from the group consisting of antibody #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68).

(A9) The anti-FSTL1 antibody or the fragment or functional equivalent thereof according to any one of items A4 to A8, wherein the antibody comprises the full-length variable regions of an antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 148; heavy chain: SEQ ID NO: 150) and #33 (light chain: SEQ ID NO: 156; heavy chain: SEQ ID NO: 158).

(A10) The anti-FSTL1 antibody or the fragment or functional equivalent thereof according to any one of items A4 to A9, wherein the antibody comprises a full-length antibody selected from the group consisting of antibody #5-8 (light chain: SEQ ID NO: 104; heavy chain: SEQ ID NO: 106), #5-10 (light chain: SEQ ID NO: 108; heavy chain: SEQ ID NO: 110), #5-43 (light chain: SEQ ID NO: 112; heavy chain: SEQ ID NO: 114), #6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #8-4 (light chain: SEQ ID NO: 128; heavy chain: SEQ ID NO: 130), #8-7 (light chain: SEQ ID NO: 132; heavy chain: SEQ ID NO: 134), #8-8 (light chain: SEQ ID NO: 136; heavy chain: SEQ ID NO: 138), #7 (light chain: SEQ ID NO: 140; heavy chain: SEQ ID NO: 142), #10 (light chain: SEQ ID NO: 144; heavy chain: SEQ ID NO: 146), #13 (light chain: SEQ ID NO: 148; heavy chain: SEQ ID NO: 150), #22 (light chain: SEQ ID NO: 152; heavy chain: SEQ ID NO: 154) and #33 (light chain: SEQ ID NO: 156; heavy chain: SEQ ID NO: 158) or a humanized sequence thereof.

(A11) The anti-FSTL1 antibody or the fragment or functional equivalent thereof according to any one of items A4 to A10, wherein the antibody comprises a full-length antibody selected from the group consisting of antibody 6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #7 (light chain: SEQ ID NO: 140; heavy chain: SEQ ID NO: 142), #10 (light chain: SEQ ID NO: 54; heavy chain: SEQ ID NO: 56), #13 (light chain: SEQ ID NO: 148; heavy chain: SEQ ID NO: 150) and #33 (light chain: SEQ ID NO: 156; heavy chain: SEQ ID NO: 158) or a humanized sequence thereof.

(A12) The anti-FSTL1 antibody or the fragment or functional equivalent thereof according to any one of items A4 to A11, wherein the antibody comprises a full-length antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 148; heavy chain: SEQ ID NO: 150) and #33 (light chain: SEQ ID NO: 156; heavy chain: SEQ ID NO: 158) or a humanized sequence thereof.

(A13) The anti-FSTL1 antibody or the fragment or functional equivalent thereof according to any one of items A1 to A12, wherein the antibody is a humanized antibody.

(A14) The anti-FSTL1 antibody or the fragment or functional equivalent thereof according to item A13, wherein the humanized antibody has a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), and a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 206, 207, 208, and 209) and light chain sequence FR1, FR2, FR3, and FR4 (SEQ ID NOs: 210, 211 or 214, 212 or 215, and 213) of corresponding chicken sequences, into amino acids in each of the chicken sequences.

(A15) The anti-FSTL1 antibody or the fragment or functional equivalent thereof according to item A13 or A14, wherein the humanized antibody has a heavy chain framework sequence comprising SEQ ID NOs: 171, 173, 175, and 177 (humanized heavy chain sequence FR1, FR2, FR3, and FR4), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), or a sequence obtained by the mutation of 1 to 8 differing amino acids in the heavy chain framework sequence from corresponding chicken heavy chain sequence FR1, FR2, FR3, and FR4 (SEQ ID NOs: 206, 207, 208, and 209, respectively) into amino acids in the chicken sequence, and has a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or a sequence obtained by the mutation of 1 to 4 differing amino acids in the light chain framework sequence from corresponding chicken light chain sequence FR1, FR2, FR3, and FR4 (SEQ ID NOs: 210, 211 or 214, 212 or 215, and 213, respectively) into amino acids in the chicken sequence.

(A16) The anti-FSTL1 antibody or the fragment or functional equivalent thereof according to item A14 or A15, wherein at least one of the differing amino acids is selected from Vernier residues.

(A17) The anti-FSTL1 antibody or the fragment or functional equivalent thereof according to any one of items A14 to A16, wherein all of the differing amino acids are selected from Vernier residues.

(A18) An anti-FSTL1 antibody, or a fragment thereof or a functional equivalent according to any one of items A1 to A17, wherein the antibody is a humanized antibody having the H chain FR1, FR2, FR3, and FR4 (SEQ ID NOs: 169, 171, 173, and 175, respectively) and L chain FR1, FR2, FR3, and FR4 (SEQ ID NOs: 185, 187, 189, and 191, respectively) of H(2)-L(1).

(A19) A medicament comprising an anti-FSTL1 antibody, or a fragment thereof or a functional equivalent according to any one of items A1 to A18.

(A20) An anticancer agent comprising an anti-FSTL1 antibody, or a fragment thereof or a functional equivalent according to any one of items A1 to A18.

(A21) A therapeutic agent for metastatic malignant tumor comprising an anti-FSTL1 antibody, or a fragment thereof or a functional equivalent according to any one of items A1 to A18.

(A22) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising an anti-FSTL1 antibody, or a fragment thereof or a functional equivalent according to any one of items A1 to A18.

(A23) An inhibitor of metastasis of cancer cells, comprising an anti-FSTL1 antibody, or a fragment thereof or a functional equivalent according to any one of items A1 to A18.

(A24) The inhibitor according to item A23, wherein the metastasis includes bone metastasis or lung metastasis.

(A25) An inhibitor of enhancement of immune defect by mesenchymal stem cells (MSCs), comprising an anti-FSTL1 antibody, or a fragment thereof or a functional equivalent according to any one of items A1 to A18.

(A26) The inhibitor according to item A25, wherein the immune defect includes immunosuppression and immunodeficiency.

(A27) The inhibitor according to item A25 or A26, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(A28) An inhibitor of acquirement and/or enhancement of immune defect activity by or of immune-related cells, comprising an anti-FSTL1 antibody, or a fragment thereof or a functional equivalent according to any one of items A1 to A18.

(A29) The inhibitor according to item A28, wherein the immune defect includes immunosuppression and immunodeficiency.

(A30) The inhibitor according to item A28 or A29, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(A31) The medicament according to item A19, the anticancer agent according to item A20, the therapeutic agent according to item A21 or A22, or the inhibitor according to any of items A23 to A30, wherein the medicament, the anticancer agent, the therapeutic agent, or the inhibitor is combined with additional cancer treatment.

(A32) The medicament, the anticancer agent, the therapeutic agent, or the inhibitor according to item A31, wherein the additional cancer treatment includes a different anticancer agent or radiation therapy, or both.

In the present invention, one or more features mentioned above are intended to be combined as stated herein and be combinable in other ways. Those skilled in the art recognize further embodiments and advantages of the present invention by reading and understanding the detailed description given below, according to the need.

Advantageous Effects of Invention

The present invention effectively suppresses the metastasis of cancer cells directly by acting on the cancer cells through the inhibition of FSTL1 or indirectly by suppressing the differentiation induction and growth of immunosuppressive or immunodeficient cells such as regulatory T cells (Tregs) or myeloid-derived suppressor cells (MDSCs) which suppress immunity, and/or the growth and differentiation induction of mesenchymal stem cells (MSCs) which promote the enhancement of immunosuppressive activity or immunodeficient activity. Furthermore, the present invention effectively suppresses even cancer metastasis considered to be difficult to suppress, particularly, bone metastasis for which an effective treatment method has not yet been established. Moreover, the present invention suppresses differentiation induction of Tregs, tumor growth, metastasis, weight loss caused by emaciation, etc., not only in bone metastasis models but in various animal cancer models. Accordingly, the present invention provides a therapeutic drug for cancer effective over multiple aspects. Also, the present invention can mitigate the whole mechanism of immunosuppression or immunodeficiency as compared with conventional ones and therefore provides even an agent for mitigation of immunosuppression or mitigation of immunodeficiency for extensive use. The agent for mitigation of immunosuppression or mitigation of immunodeficiency of the present invention is not an agent that removes some immunosuppressive cell populations such as regulatory T cells or regulatory dendritic cells or inhibits their functions, and therefore circumvents broad conventional limitations to agents for mitigation of immunosuppression. Thus, the agent of the present invention is also effective against exhausted T cells. Hence, the agent of the present invention also has an immunodeficiency-mitigating effect and is also useful as an agent for mitigation of immune defect.

BRIEF DESCRIPTION OF DRAWINGS

FIG. 1 is graphs showing the binding activity of the antibody of the present invention against FSTL1 (Example 2). Part A shows results of evaluating the binding activity of clones obtained by initial screening against human FSTL1 by ELISA. The open rhomboid depicts clone #5-2, the cross mark depicts clone #5-4, the filled triangle depicts clone #5-8, the open circle depicts clone #5-10, the open square depicts clone #5-43, the open triangle depicts clone #6-55, the filled circle depicts clone #7-34, and the filled square depicts a control anti-dinitrophenyl (DNP) antibody. The strength of the binding activity was #5-10, #6-55, and #7-34>#5-3>#5-8>#5-43. Part B shows results of examining the cross reactivity between mice and humans. Among the antibodies shown in part A, clones that also exhibited reactivity with mouse FSTL1 in the screening were evaluated for their binding activity. The binding activity against human FSTL1 is shown on the left, and the binding activity against mouse FSTL1 is shown on the right. Both #6-55 and #7-34 exhibited strong binding activity against human and mouse FSTL1. In FIG. 1, the antibody concentration was diluted from 1000 ng/ml. For experiments shown in FIG. 2 or subsequent figures, the concentration was further diluted and used in the experiments.

FIG. 3A shows results of evaluating the binding activity of clones also including clones (#7, #10, #13, #22, and #33) obtained by panning using mouse FSTL1 against human FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against human FSTL1 was #6-55, #7-34, and #13>#8-1 and #10>#8-4>#7 and #33>#5-8>#22. The binding activity of the anti-DNP antibody was not observed. FIG. 3B shows results of evaluating the binding activity of the same clones as above against mouse FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against mouse FSTL1 was #6-55, #7-34, #10, and #13>#22>#7>#33>#8-1. #8-1 slightly exhibited binding activity. #5-8, #8-4, and the anti-DNP antibody exhibited no binding activity. The antibody concentration in FIG. 3 was diluted from 100 ng/ml. On the basis of these ELISA results of binding activity and in vitro evaluation, promising clones to be subjected to in vivo evaluation were narrowed down (#6-55, #7-34, and #8-1). Clones newly obtained by panning (#7, #10, #13, #22, and #33) were further used as subjects in the in vivo evaluation.

FIG. 19 shows results of a Treg induction experiment in which activity was measured with % CD4+ Foxp3+CTLA+ cells as an index in an experimental system involving the anti-FSTL1 antibody (#6-55) of the present invention and a known anti-FSTL1 antibody (R&D Systems, Inc., Cat. No. MAB1694, clone 229007). The double circle, the circle, and the triangle depict statistical significance and represent 30% or more decrease, 10% to 30% decrease, and less than 10% decrease, respectively. The cross mark represents the absence of statistically significant difference.

FIGS. 24A-24D show results of comparing in vivo drug efficacy between antibody drugs for immune mitigation already used clinically and an anti-FSTL1 antibody using Snail+ tumor bone metastasis models. In FIG. 24A, the upper graphs show tumor growth, and the lower graphs show bone metastasis, sMSCs in bone marrow, and sMSCs in the spleen. In the upper graphs of the tumor growth, no treatment, a control, an anti-CTLA4 antibody, an anti-PD1 antibody, an anti-PD-L1 antibody, and the anti-FSTL1 antibody are depicted from the left to the right. Statistical significance is indicated by p value. The x-axis shows the number of days after tumor implantation (the p values are values of day 14). The y-axis shows tumor volume (mm$^3$). As for the bone metastasis and two sMSC grafts, no treatment, a control, an anti-CTLA4 antibody, an anti-PD1 antibody, an anti-PD-L1 antibody, the anti-FSTL1 antibody, and naive (non-tumor model) are also depicted from the upper to lower bars. The abscissas show the number of GFP$^+$ tumor cells, the number of CD45$^-$ALCAM$^+$ cells, and the number of CD45$^-$ALCAM$^+$ cells, respectively.

FIG. 24B shows cell groups in charge of antitumor immunity that invaded tumor. CD4$^+$ T cells (CD45$^+$CD3$^+$ CD4$^+$ cells), tumor-specific CD8$^+$ T cells (CD45$^+$CD8$^+$ tetramer$^+$), and activated NK cells (CD45$^+$NK1.1$^+$ NKG2D$^+$) are depicted from the left to the right. The upper graphs show the percentage of positive cells. The lower graphs show the number of cells per mm$^3$. In each graph, no treatment, a control, an anti-CTLA4 antibody, an anti-PD1 antibody, an anti-PD-L1 antibody, and the anti-FSTL1 antibody are depicted from the upper to lower bars.

FIG. 24C shows results of the same experiment as in FIG. 24B and shows the results about an immunosuppressive T cell group that invaded tumor and highly metastatic tumor cells in subcutaneous tumor. CD4+ Tregs (CD45$^+$CD4$^+$ Foxp3$^+$ Tregs), MDSCs (CD45$^+$CD11b$^+$Gr1$^+$ MDSCs), and tumor cells having EMT (Snail$^+$CD44$^+$ tumors) are depicted from the left to the right. The description of the graphs is the same as in FIG. 24B. No treatment, a control, an anti-CTLA4 antibody, an anti-PD1 antibody, an anti-PD-L1 antibody, and the anti-FSTL1 antibody are depicted from the upper to lower bars.

FIG. 24D shows results obtained in immunocyte groups in the spleen. Tumor-specific CD8$^+$ T cells (CD3$^+$CD8$^+$ tetramer$^+$ CTLs), CD4$^+$ Tregs (CD4$^+$CTLA4$^+$Foxp$^+$ Tregs), and CD8$^+$ Tregs (CD8$^+$CTLA4$^+$Foxp3$^+$ Tregs) are depicted from the left to the right. The graphs show the number of cells per spleen (indicated by ×10⁶). No treatment, a control, an anti-CTLA4 antibody, an anti-PD1 antibody, an anti-PD-L1 antibody, and the anti-FSTL1 antibody are depicted from the upper to lower bars.

FIG. 26 shows change in tumor volume (mm³) after tumor implantation. The results about control immunoglobulin and the antibody #6-55, #7, #10, #13, and #33 of the present invention are shown from the left to the right. Statistical significance (p value) compared with a control is indicated within parentheses, and statistical significance vs. #6-55 is connected by a line and indicated by p value. The abscissa shows the number of days after tumor implantation.

FIG. 27 FIGS. 26 and 27 show the results of evaluating the in vivo drug efficacy of each anti-FSTL1 antibody clone using Snail+ tumor bone metastasis models.

FIG. 27 shows survival rate. The abscissa shows the number of days after tumor implantation. The ordinate shows mouse survival rate (n=5). The results about control immunoglobulin and the antibody #6-55, #7, #10, #13, and #33 of the present invention are shown. Black thin dotted line for #6-55, gray bold dotted line for #7, black bold line for #10, gray bold line for #13, and black bold dotted line for #33 are shown. Statistical significance values (p value) vs. the control immunoglobulin are indicated, and statistical significance (p value) vs. #6-55 indicated within parentheses.

FIG. 29 shows results of comparing binding activity using combinations of humanized 6-55 antibody H chains (IgG1 type) and L chains. The open circle with the black bold line shows the results about humanized antibody H1-L1, the square with the black bold line shows the results about H2-L1, the open triangle with the black bold line shows the results about H3-L1, the filled square with the black dotted line shows the results about humanized antibody H1-L2, the filled triangle with the black dotted line shows the results about H2-L2, the filled circle with the black dotted line shows the results about H3-L2, and the gray square with the gray bold line shows the results about humanized antibody H1-L1, and the gray triangle with the gray dotted line shows the results about H2-L1, and the gray circle with the gray bold line shows the results about H3-L1. Antibody concentrations are indicated on the abscissa, and OD450 values are indicated. H2-L1 was found to be best.

FIG. 30 FIGS. 29 and 30 show ELISA results of humanized antibodies. FIG. 30 shows the binding activity of humanized #6-55 H2-L1 (IgG1 type) of the antibody of the present invention against human and mouse FSTL1. The left graph shows the binding activity against human FSTL1, and the right graph shows the binding activity against mouse FSTL1. In both graphs, the filled circle depicts a human #6-55 antibody, and the open square depicts a human anti-DNP antibody. Antibody concentrations are indicated on the abscissa, and OD490/630 values are indicated.

In FIG. 31, the antibody concentration was diluted from 1000 ng/ml. For experiments shown in FIG. 32 or subsequent figures, the concentration was further diluted and used in the experiments.

FIG. 49B shows results of a Treg induction experiment in which activity was measured with % CD4+ Foxp3+CTLA+ cells as an index in an experimental system involving the anti-FSTL1 antibody (#6-55) of the present invention and a known anti-FSTL1 antibody (R&D Systems, Inc., Cat. No. MAB1694, clone 229007). The double circle, the circle, and the triangle depict statistical significance and represent 30% or more decrease, 10% to 30% decrease, and less than 10% decrease, respectively. The cross mark represents the absence of statistically significant difference.

In FIG. 54A, the upper graphs show tumor growth, and the lower graphs show bone metastasis, sMSCs in bone marrow, and sMSCs in the spleen. In the upper graphs of the tumor growth, no treatment, a control, an anti-CTLA4 antibody, an anti-PD1 antibody, an anti-PD-L1 antibody, and the anti-FSTL1 antibody are depicted from the left to the right. Statistical significance is indicated by p value. The x-axis shows the number of days after tumor implantation (the p values are values of day 14). The y-axis shows tumor volume (mm$^3$). As for the bone metastasis and two sMSC grafts, no treatment, a control, an anti-CTLA4 antibody, an anti-PD1 antibody, an anti-PD-L1 antibody, the anti-FSTL1 antibody, and naive (non-tumor model) are also depicted from the upper to lower bars. The abscissas show the number of GFP$^+$ tumor cells, the number of CD45$^-$ALCAM$^+$ cells, and the number of CD45$^-$ALCAM$^+$ cells, respectively.

FIG. 54B shows cell groups in charge of antitumor immunity that invaded tumor. CD4$^+$ T cells (CD45$^+$CD3$^+$ CD4$^+$ cells), tumor-specific CD8$^+$ T cells (CD45$^+$CD8$^+$ tetramer$^+$), and activated NK cells (CD45$^+$NK1.1$^+$ NKG2D$^+$) are depicted from the left to the right. The upper graphs show the percentage of positive cells. The lower graphs show the number of cells per mm$^3$. In each graph, no treatment, a control, an anti-CTLA4 antibody, an anti-PD1 antibody, an anti-PD-L1 antibody, and the anti-FSTL1 antibody are depicted from the upper to lower bars.

FIG. 54C shows results of the same experiment as in FIG. 54B and shows the results about an immunosuppressive T cell group that invaded tumor and highly metastatic tumor cells in subcutaneous tumor. CD4$^+$ Tregs (CD45$^+$CD4$^+$ Foxp3+ Tregs), MDSCs (CD45+CD11b+Gr1+ MDSCs), and tumor cells having EMT (Snail+CD44+ tumors) are depicted from the left to the right. The description of the graphs is the same as in FIG. 54B. No treatment, a control, an anti-CTLA4 antibody, an anti-PD1 antibody, an anti-PD-L1 antibody, and the anti-FSTL1 antibody are depicted from the upper to lower bars.

FIG. 54D shows results obtained in immunocyte groups in the spleen. Tumor-specific CD8+ T cells (CD3+CD8+ tetramer+ CTLs), CD4+ Tregs (CD4+CTLA4+Foxp+ Tregs), and CD8+ Tregs (CD8+CTLA4+Foxp3+ Tregs) are depicted from the left to the right. The graphs show the number of cells per spleen (indicated by ×10$^6$). No treatment, a control, an anti-CTLA4 antibody, an anti-PD1 antibody, an anti-PD-L1 antibody, and the anti-FSTL1 antibody are depicted from the upper to lower bars.

FIG. 56 shows change in tumor volume (mm$^3$) after tumor implantation. The results about control immunoglobulin and the antibody #6-55, #7, #10, #13, and #33 of the present invention are shown from the left to the right. Statistical significance (p value) compared with a control is indicated within parentheses, and statistical significance vs. #6-55 is connected by a line and indicated by p value. The abscissa shows the number of days after tumor implantation.

FIG. 57 FIGS. 56 and 57 show the results of evaluating the in vivo drug efficacy of each anti-FSTL1 antibody clone using Snail+ tumor bone metastasis models.

FIG. 57 shows survival rate. The abscissa shows the number of days after tumor implantation. The ordinate shows mouse survival rate (n=5). The results about control immunoglobulin and the antibody #6-55, #7, #10, #13, and #33 of the present invention are shown. Statistical significance values (p value) vs. the control immunoglobulin are indicated by black thin dotted line for #6-55, gray bold dotted line for #7, black bold line for #10, gray bold line for #13, and black bold dotted line for #33 with statistical significance (p value) vs. #6-55 indicated within parentheses.

FIG. 59 shows results of comparing binding activity using combinations of humanized 6-55 antibody H chains (IgG1 type) and L chains. The open circle with the black bold line shows the results about humanized antibody H1-L1, the square with the black bold line shows the results about H2-L1, the open triangle with the black bold line shows the results about H3-L1, the filled square with the black dotted line shows the results about humanized antibody H1-L2, the filled triangle with the black dotted line shows the results about H2-L2, the filled circle with the black dotted line shows the results about H3-L2, and the gray square with the gray bold line shows the results about humanized antibody H1-L1, and the gray triangle with the gray dotted line shows the results about H2-L1, and the gray circle with the gray bold line shows the results about H3-L1. Antibody concentrations are indicated on the abscissa, and OD450 values are indicated. H2-L1 was found to be best.

FIG. 60 FIGS. 59 and 60 show ELISA results of humanized antibodies. FIG. 60 shows the binding activity of humanized #6-55 H2-L1 (IgG1 type) of the antibody of the present invention against human and mouse FSTL1. The left graph shows the binding activity against human FSTL1, and the right graph shows the binding activity against mouse FSTL1. In both graphs, the filled circle depicts a human #6-55 antibody, and the open square depicts a human anti-DNP antibody. Antibody concentrations are indicated on the abscissa, and OD490/630 values are indicated.

In FIG. 63, the antibody concentration was diluted from 1000 ng/ml. For experiments shown in FIG. 64 or subsequent figures, the concentration was further diluted and used in the experiments.

(Example 8; the FSTL1 concentration was set to a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Inhibitory activity was confirmed in clone #5-8, #5-43, #6-55, #8-1, and #8-8. Part B shows the influence of antibodies on an effect of inducing RANKL- and CCR2-positive cells in a human pancreatic cancer cell line Pancl by FSTL1 (Example 9; the FSTL1 concentration was set to a low concentration of 20 ng/ml). The expression of RANKL and CCR2 among molecules known as bone metastasis markers was analyzed by flow cytometry, and the numbers of positive cells were indicated in graphs. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Clone #5-8 and #6-55 exhibited higher inhibitory activity.

Figure 68A:
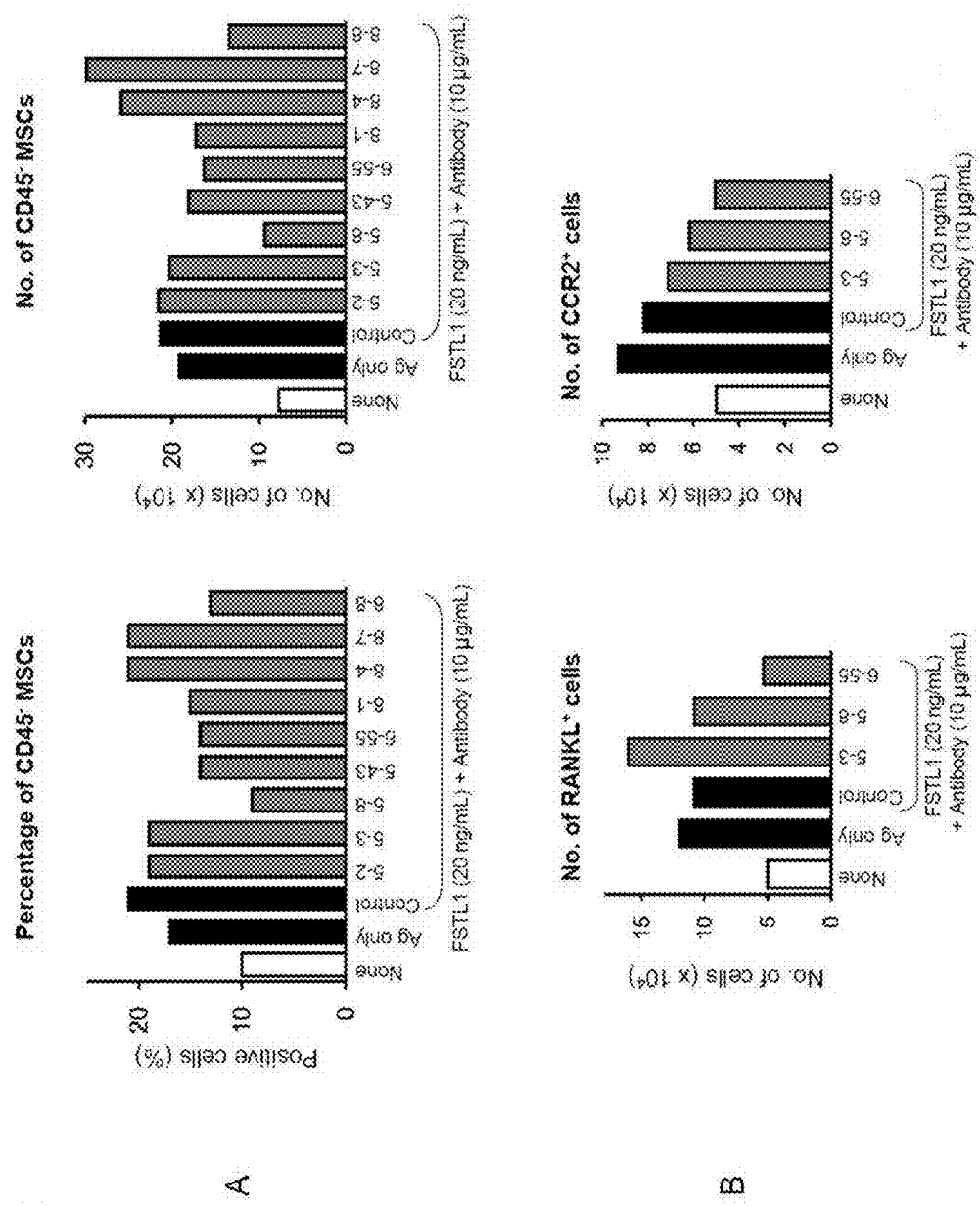
FIG. 68A also shows results indicating effects brought about by the suppression of FSTL1 on mesenchymal stem cells and bone metastasis (Examples 8 to 11). Part A shows the influence of antibodies on an effect of inducing mouse bone marrow-derived mesenchymal stem cells by FSTL1
Figure 68B:
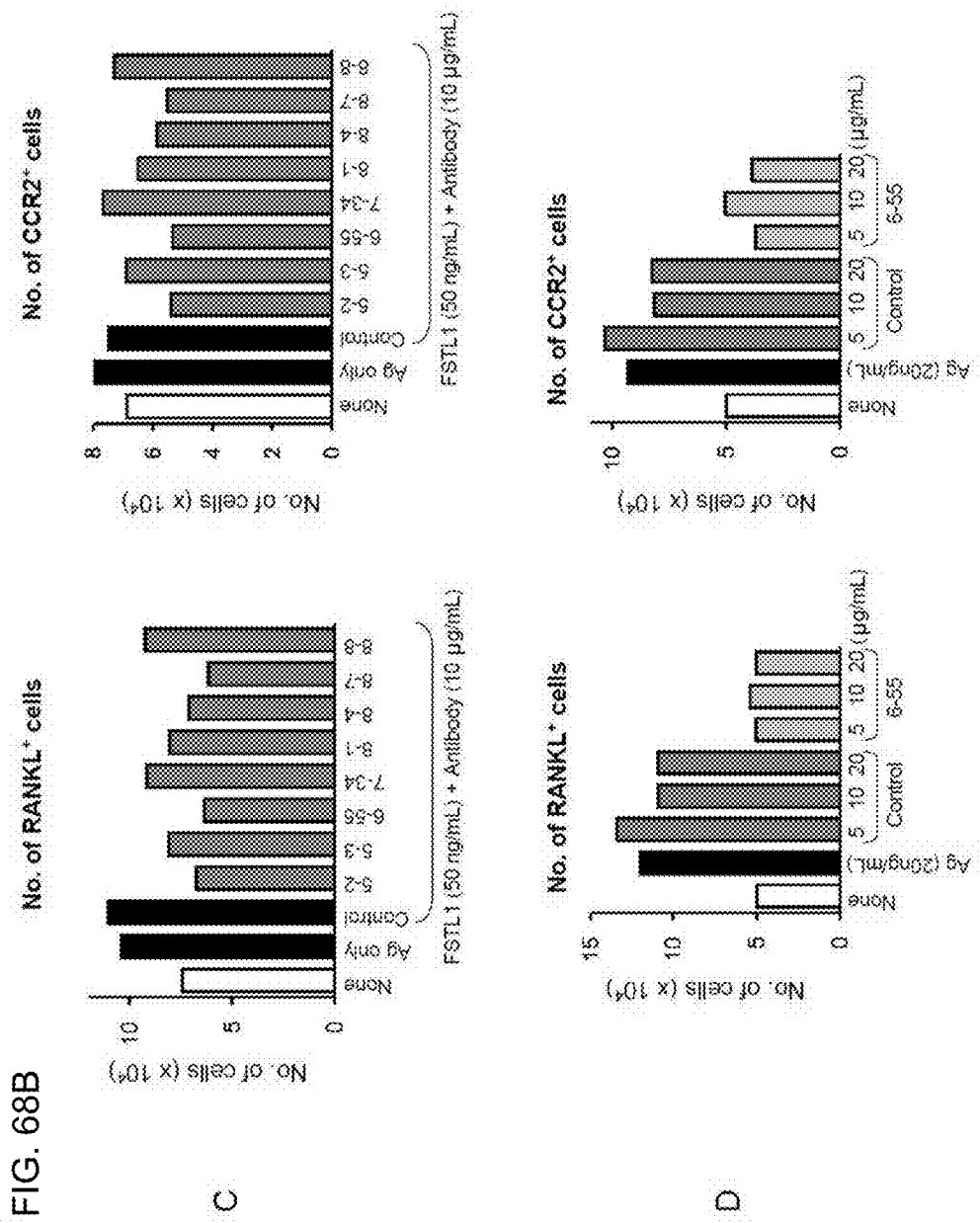

FIG. 68B Part C shows the influence of antibodies on an effect of inducing RANKL- and CCR2-positive cells in a human pancreatic cancer cell line Pancl by FSTL1 (Example 10). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity, as compared with the control antibody (anti-DNP antibody). Particularly, clone #5-2, #6-55, #8-4, and #8-7 exhibited higher inhibitory activity. FIG. 68D shows the influence of an antibody on an effect of inducing RANKL- and CCR2-positive cells in a human pancreatic cancer cell line Pancl by FSTL1. Here, an antibody dose dependence test was conducted (Example 11). The expression of RANKL and CCR2 among molecules known as bone metastasis markers was analyzed by flow cytometry, and the numbers of positive cells were indicated in graphs. Clone #6-55 exhibited inhibitory activity, as compared with the control antibody (anti-DNP antibody), though the dose dependence of the antibody was not confirmed. The clone shown in the graphs is depicted on the right bars, a control antibody (anti-DNP antibody) is depicted on the third bar from the left, an antigen alone is depicted on the second bar from the left, and a non-supplemented sample is depicted on the leftmost bar. Clone #6-55 strongly inhibited the cell induction of both RANKL-positive cells and CCR2-positive cells at the same time.

Figure 69:
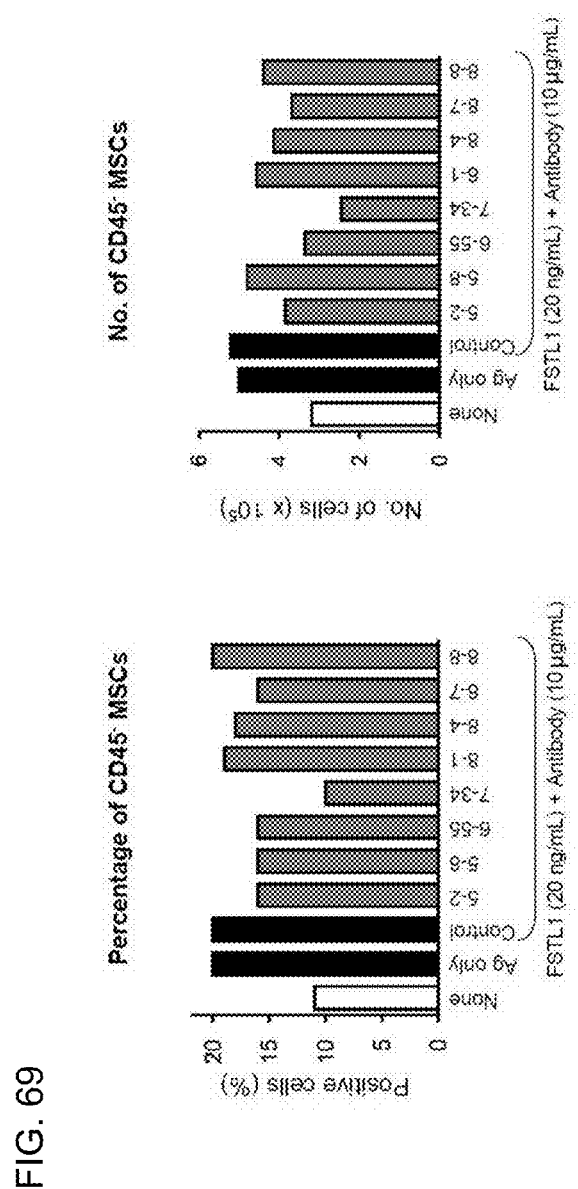

FIG. 69 shows the influence of antibodies on an effect of inducing mouse bone marrow-derived mesenchymal stem cells by FSTL1 (Example 12; the FSTL1 concentration used was a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity against the action of FSTL1, as compared with the control antibody (anti-DNP antibody). Particularly, stronger inhibitory activity was confirmed in the order of clone #7-34, #5-2, #6-55, and #8-7.

Figure 70:
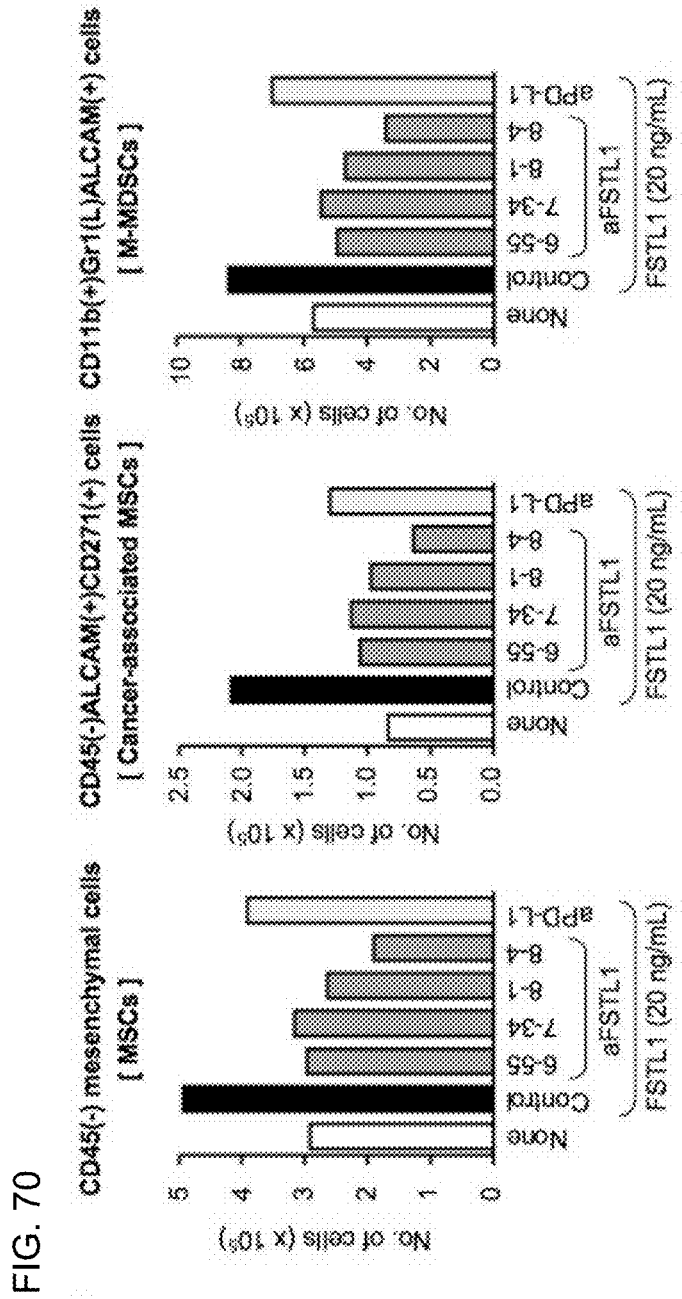

FIG. 70 shows results of evaluating the activity of anti-FSTL1 antibodies and an anti-PD-L1 antibody produced for in vivo (Example 13). Mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CDllb-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody is depicted in the second bar from the left, the anti-PD-L1 antibody is depicted in the rightmost bar, and intermediate 4 clones respectively represent the anti-FSTL1 antibodies. These antibodies produced for in vivo were found to be appropriate antibodies because all of the antibodies exhibited high inhibitory activity, as in the results mentioned above, as compared with the control antibody. PD-L1 is expressed in MSCs and presumably influences the induction of MSCs. However, inhibitory activity was found to be stronger in the anti-FSTL1 antibodies.

Figure 71:
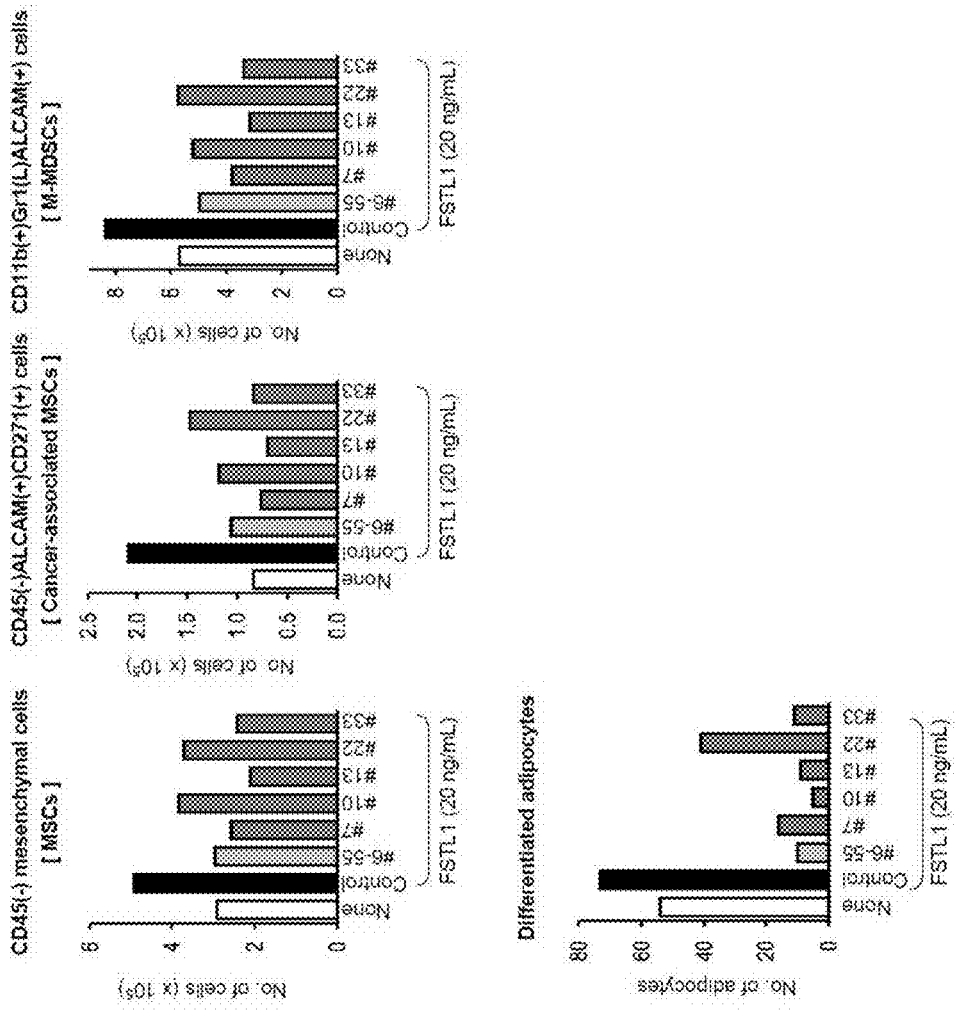

FIG. 71 Part A shows results of conducting the same test as that of FIG. 70 using other clones (clones described in each graph) (Example 14). As in FIG. 70, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CDllb-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody (anti-DNP antibody) is depicted shown in the second bar from the left, the anti-PD-L1 antibody is depicted in the rightmost bar, and intermediate 4 clones respectively represent the anti-FSTL1 antibodies. As a result, all of the clones exhibited inhibitory activity against the induction of MSCs, cancer-associated MSCs, and MDSCs by FSTL1, as compared with the control antibody. Among them, #13 and #33 exhibited inhibitory activity equivalent to or higher than that of the positive control (#6-55). These results seem to be reasonable because epitopes for #13 and #6-55 are the same regions. Part B shows results of analyzing inhibitory activity against the induction of MSCs having the ability to differentiate into adipocytes. In the graph, none is depicted in the leftmost bar, and a control is depicted in the second bar from the left followed by anti-FSTL1 antibody clones. All of the anti-FSTL1 antibody clones exhibited inhibitory activity against the differentiation induction of MSCs having the ability to differentiate into adipocytes by FSTL1.

Figure 72:
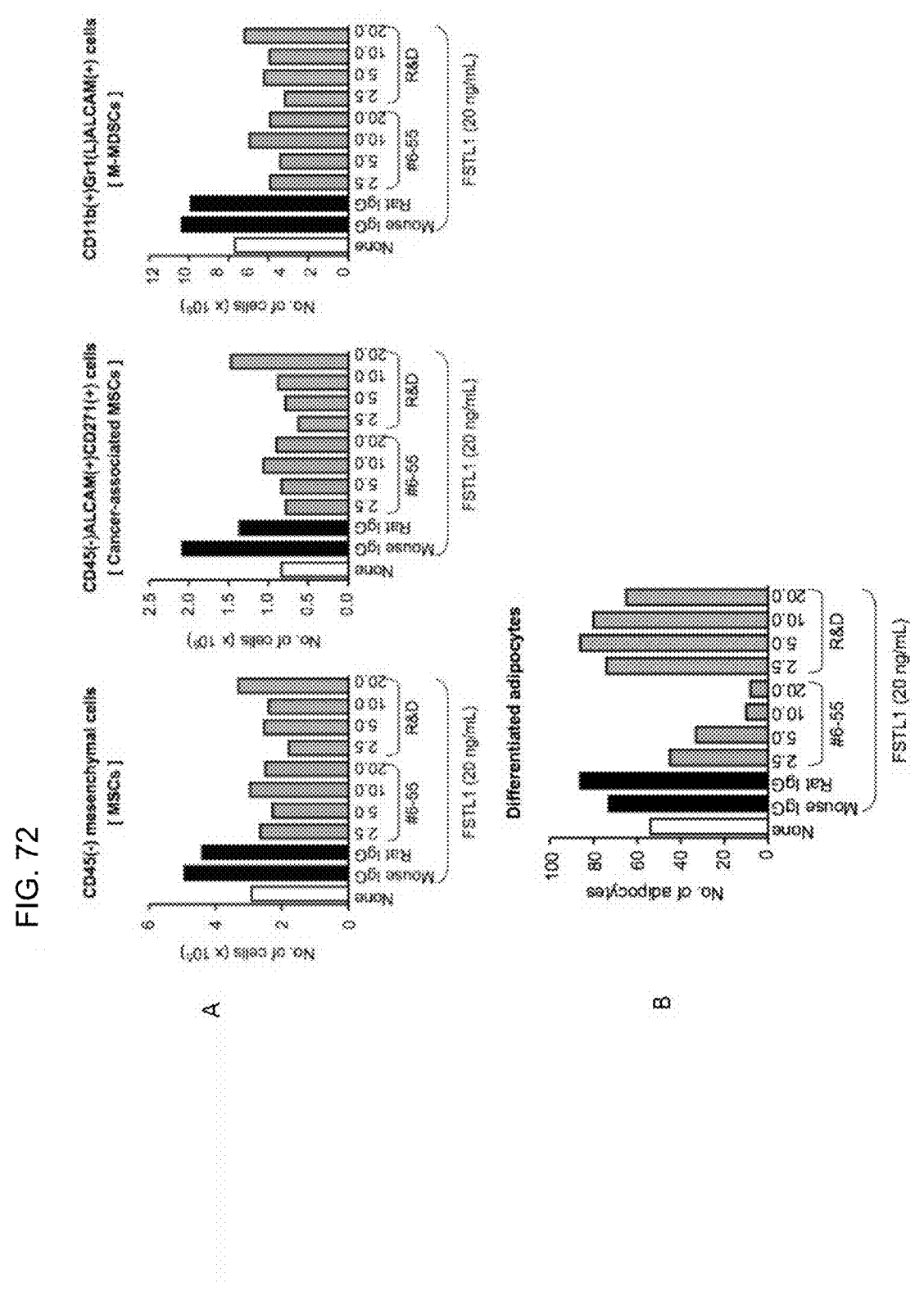

FIG. 72 shows activity comparison with an anti-FSTL1 antibody manufactured by R&D Systems, Inc. evaluated in Examples of Patent Literature 1 (WO2009/028411) (Examples 15 and 16). Part A shows results of conducting a dose dependence test in order to compare #6-55 (mouse chimeric antibody) with the anti-FSTL1 antibody manufactured by R&D Systems, Inc. (rat antibody; indicated by R&D), and analyzing inhibitory activity against the action of FSTL1 in the same way as in FIG. 70 (Example 15). In Part A, as in FIG. 70, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CDllb-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The antibody manufactured by R&D Systems, Inc. exhibited inhibitory activity against the induction of each cell by FSTL1 at the same level as in #6-55. No dose-dependent effect was confirmed. When the antibody of each isotype is used as a reference, the inhibitory activity of #6-55 is considered to be slightly superior. Part B shows results of analyzing inhibitory activity against the induction of MSCs having the ability to differentiate into adipocytes (Example 16). In the graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The induction of MSCs having the ability to differentiate into adipocytes was inhibited by #6-55 in an antibody dose-dependent manner. On the other hand, the antibody manufactured by R&D Systems, Inc. exhibited no inhibitory activity, demonstrating the superiority of the antibody of #6-55. The ability to differentiate into adipocytes is one of the functions of cancer-associated MSCs (cells also shown in the middle graph of Part A) inducing immunosuppression. From the comparison of Part A with Part B, it can be concluded that: when the rat control antibody, i.e., a "rat-derived protein", was administered into the living bodies of mice, its own response was reduced, as compared with the case of administering the mouse control antibody (mouse-derived protein) (particularly, the middle graph of Part A). This is presumably because immune response to foreign matter occurred slightly because mouse bone marrow cells were used. In the case of administering the FSTL1 antibody of R&D Systems, Inc., which is also a "rat-derived protein", comparison with this rat control antibody administration group was supposed to be reasonable. Nonetheless, in light of the "rate of suppression" with respect to each control protein, the rate of suppression of the FSTL1 antibody of R&D Systems, Inc. with respect to the rat control antibody administration group was smaller than the rate of suppression of 6-55 with respect to the mouse control antibody administration group, suggesting that #6-55 is superior as a matter of fact. Not all of CD45-negative MSCs induced by FSTL1 are cancer-associated MSCs which cause immunosuppression, and such cancer-associated MSCs need to be identified using several types of markers, the ability to differentiate into adipocytes, etc. It can be concluded that the antibody of the present invention can strongly inhibit the induction of cancer-associated MSCs by inhibiting the action of FSTL1.

Figure 73A:
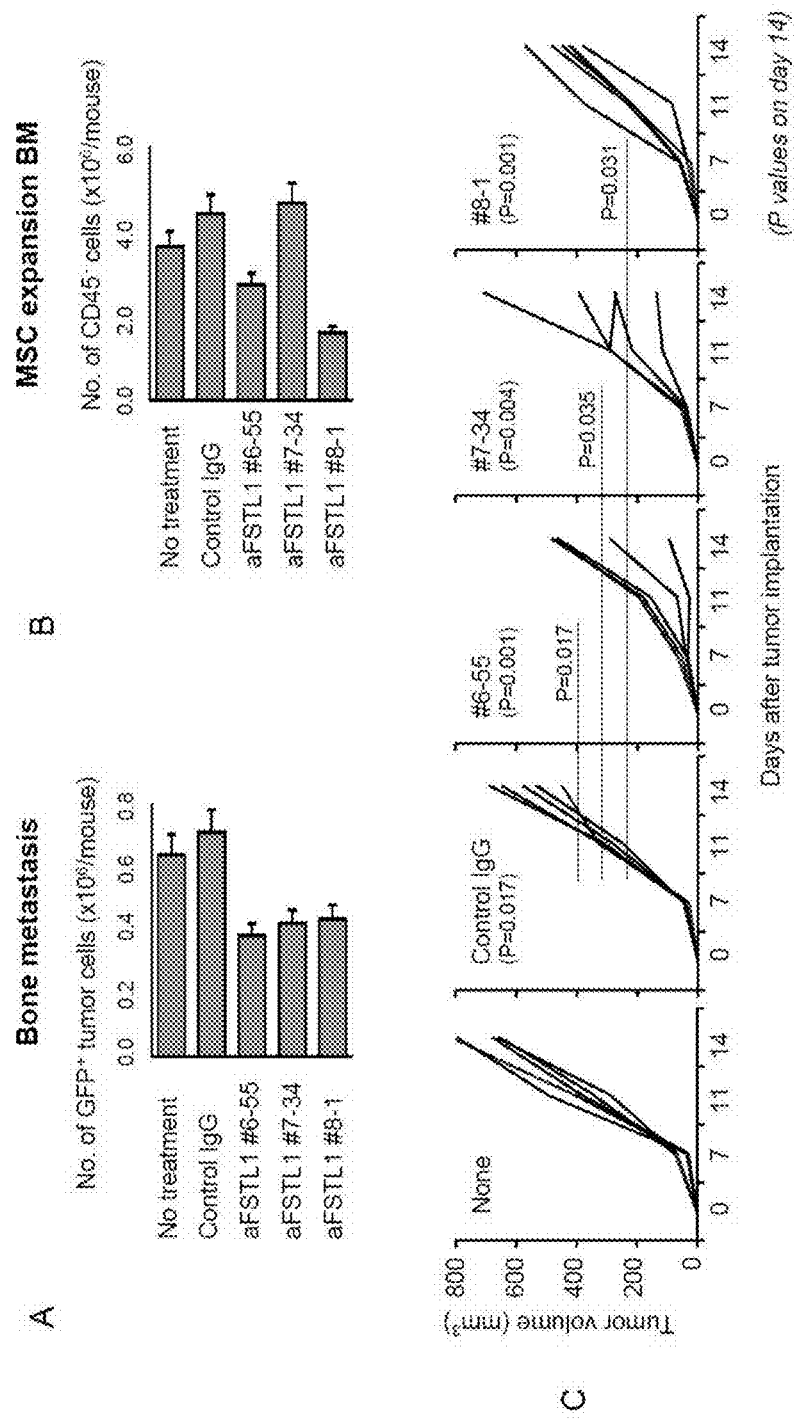

FIG. 73A shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 μg/0.1 mL/tumor). On day 14, various assays were conducted. Part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). Part B (the number of CD45-negative cells in bone marrow) shows results of analyzing the percentage (%) of CD45-negative cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). In both bar graphs, groups respectively receiving no treatment, a control antibody, clone #6-55, #7-34, and #8-1 are depicted from the upper to lower bars. Part C (tumor volume of each mouse individual) shows the tumor volume of each mouse individual (one line represents one mouse) measured 7, 11, and 14 days after tumor implantation, and shows the effects of various antibodies on tumor growth (subcutaneously transplanted tumor growth was suppressed). Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34.

Figure 73B:
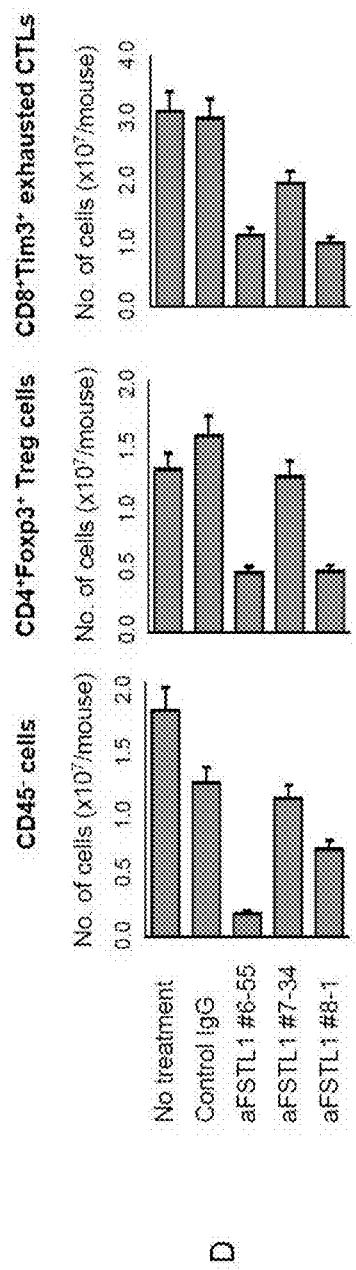

FIG. 73B shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 μg/0.1 mL/tumor). On day 14, various assays were conducted. Part D shows change in cell populations in the spleen. As presented, even if an antibody is administered locally, for example, into tumor, the whole body receives modification or influence. The left graph shows the number of CD45-negative cells and shows that MSCs also decrease in number in the spleen. The middle graph shows the number of CD4-positive and Foxp3-positive T cells and shows that Tregs decrease in number. The right graph shows the number of CD8-positive and Tim3-positive T cells and shows that exhausted CD8-positive T cells decrease in number. In this context, the exhaustion refers to a state having functional decline or dysfunction. Tim3 is a marker that reflects the state. If CD8-positive T cells supposed to kill tumor cells fall into an exhausted state, cancer cells cannot be eliminated from the living body.

Figure 74A:
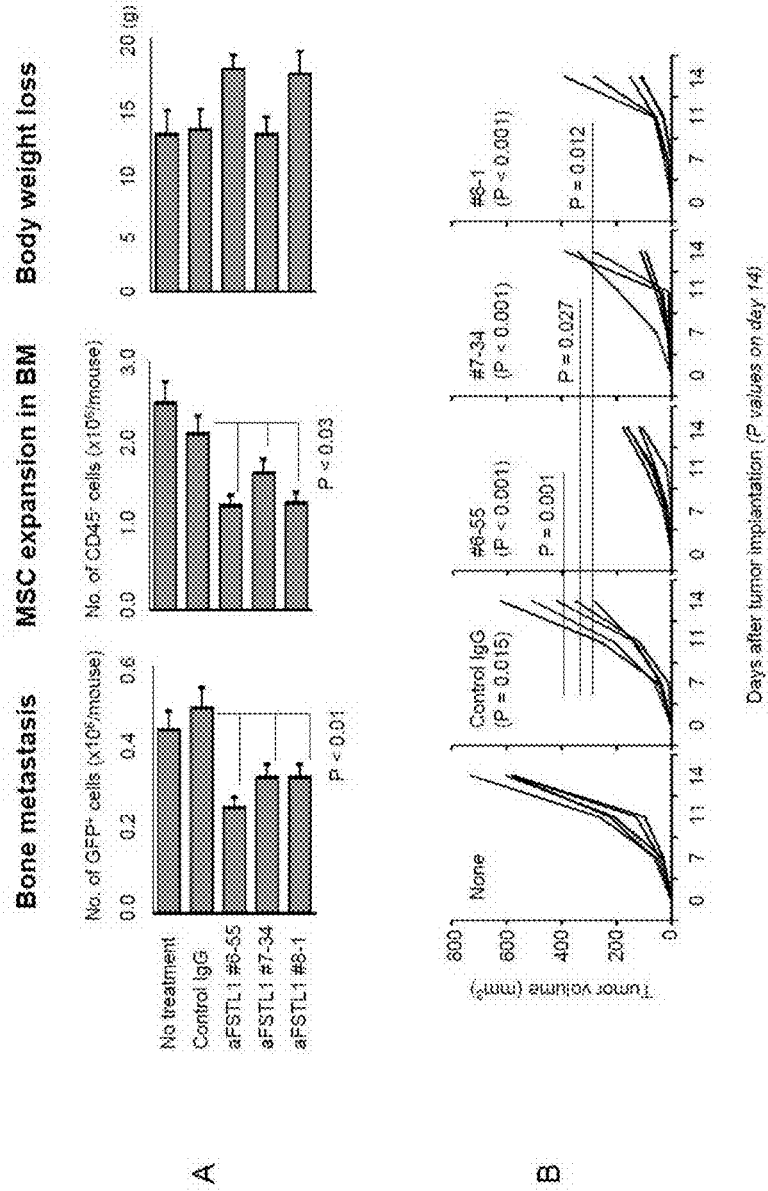

FIG. 74A also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5\times10^5$ cells subcutaneously & $1\times10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. The left graph of Part A (the number of tumor cells that metastasized into bone marrow) shows results of analyzing the percentage (%) of GFP-positive tumor cells in bone marrow cells by flow cytometry and then counting the number of GFP-positive tumor cells ($\times10^6$ cells) per mouse on the basis of this data, and shows the effects of various antibodies on bone metastasis (bone metastasis was suppressed). The middle graph of Part A (the number of CD45-negative cells in bone marrow) shows results of analyzing the percentage (%) of CD45– cells in bone marrow cells by flow cytometry and then counting the number of CD45-negative bone marrow cells ($\times10^6$ cells) per mouse on the basis of this data, and shows the effects of various antibodies on MSC expansion in bone marrow (MSC expansion in bone marrow was suppressed). The right graph of Part A (mouse body weight) shows effects on weight change (although a mouse is emaciated by bone metastasis, this was found to be suppressed as a result of measuring the body weight as an index thereof). In the bar graphs of Part A, groups respectively receiving no treatment, a control antibody, clone #6-55, #7-34, and #8-1 are depicted from the upper to lower bars. Five graphs of Part B show the tumor volume of each mouse individual (one line represents one mouse) measured 7, 11, and 14 days after tumor implantation, and show the effects of various antibodies on tumor growth. Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies to be tested significantly suppressed the growth of subcutaneous tumor with respect to the control antibody. In addition, an anti-weight loss effect was confirmed by the administration of #6-55 and #8-1.

Figure 74B:
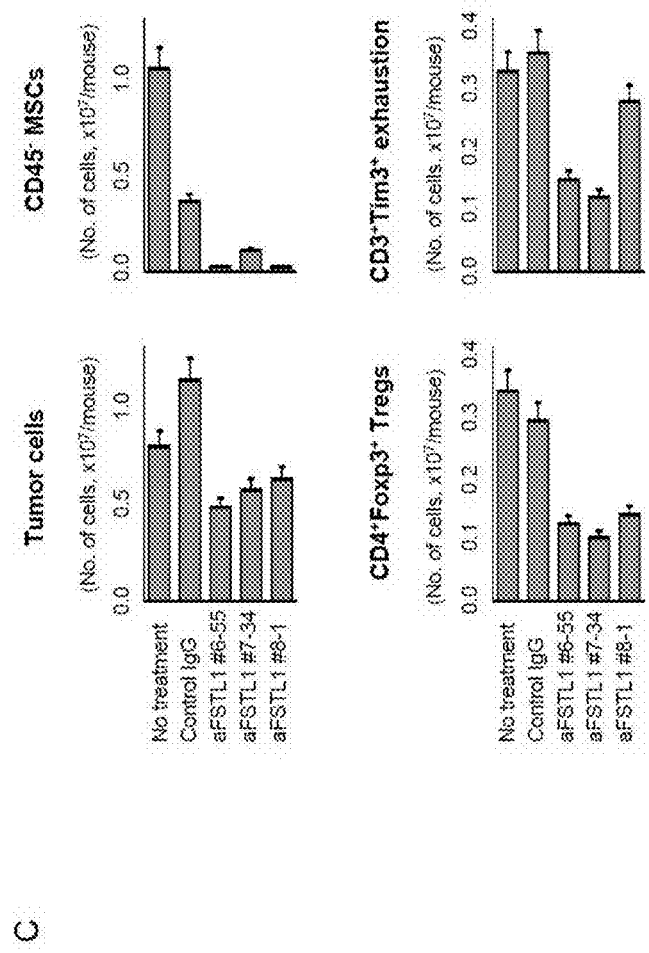

FIG. 74B also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5\times10^5$ cells subcutaneously & $1\times10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. Part C shows change in cell populations in the spleen. The upper left graph of Part C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Figure 75:
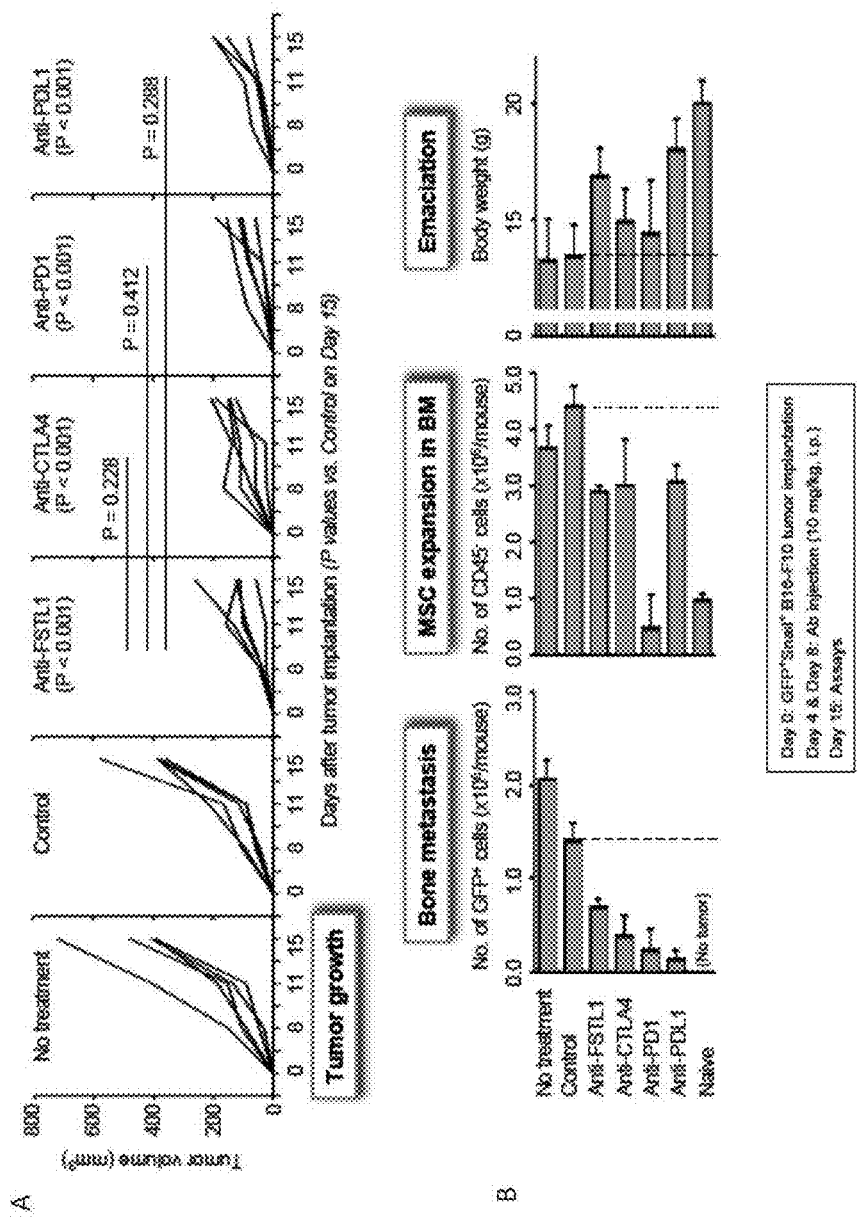

FIG. 75 also shows results of evaluating antibody activity in vivo (Example 19). This figure shows results of comparing drug efficacy between existing antibody drugs for mitigation of immunosuppression and an anti-FSTL1 antibody using bone metastasis models having a transplant of mouse melanoma B16-F10 cells forced to express Snail. Part A shows the effects of various antibodies on tumor volume over time. This figure shows the tumor volume of each mouse individual (one line represents one mouse) measured 8, 11, and 15 days after tumor implantation, and shows the effects of various antibodies on tumor growth. No treatment, a control antibody, an anti-FSTL1 antibody, an anti-CTLA4 antibody, an anti-PD-1 antibody, and an anti-PD-L1 antibody are depicted from the left to the right. The numerical values within the parentheses and the numerical values on the lines (indicated by P) represent p values regarding statistical significance (day 15). The abscissa shows the number of days. The ordinate shows tumor volume (mm3). On day 0, GFP-positive and Snail-positive B16-F10 tumor cells were transplanted ($5\times10^5$ cells subcutaneously & $1\times10^5$ cells intravenously). On day 4, the antibody was intraperitoneally administered (first dose, corresponding to 200 µg/mouse=10 mg/kg). On day 8, the antibody was intraperitoneally administered (second dose, corresponding to 200 µg/mouse=10 mg/kg). On day 15, various assays were conducted. The left graph of Part B shows effects on bone metastasis (the number of GFP-positive cells ($10^6$/mouse)). The middle graph of Part B shows effects on MSC expansion in bone marrow (the number of CD45-negative cells (($10^6$/mouse)). The right graph of Part B shows effects on weight change (body weight (g)). All of the graphs of Part B depict no treatment, a control antibody, an anti-FSTL1 antibody, an anti-CTLA4 antibody, an anti-PD-1 antibody, and an anti-PD-L1 antibody from the upper to lower bars. The following existing antibody drugs were used as control antibodies: Anti-CTLA4 mAb (clone 9H10, BioLegend, Inc.); Anti-PD-1 mAb (clone 29F.1A12, BioLegend, Inc.); and Anti-PD-L1 mAb (clone 10F.9G2, BioLegend, Inc.). In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Figure 76B:
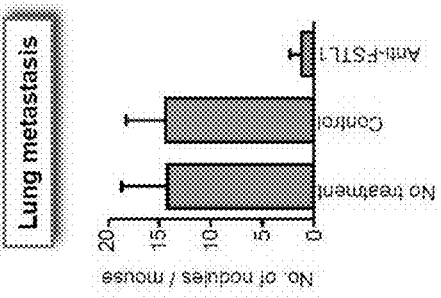
Figure 76A:
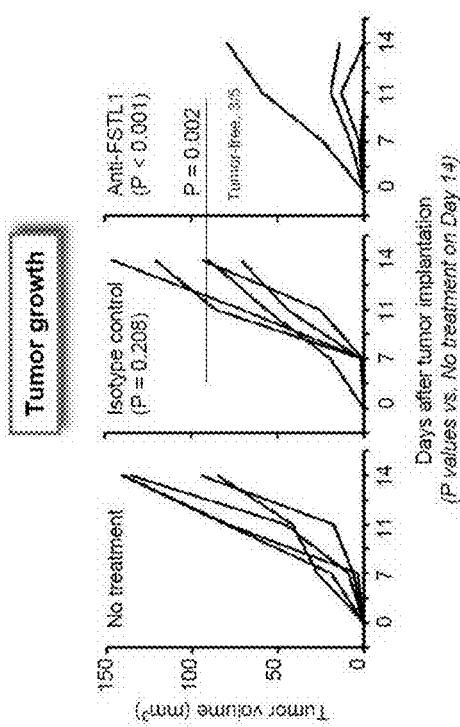

FIG. 76A also shows results of evaluating antibody activity in vivo (Example 20). This figure shows results of evaluating the drug efficacy of an anti-FSTL1 antibody using mouse colorectal cancer CT26 cell-transplanted models. All of the 3 graphs of FIG. 76A show effects on tumor growth. This figure shows the tumor volume of each mouse individual (one line represents one mouse) measured 7, 11, and 14 days after tumor implantation, and shows the effects of various antibodies on tumor growth. The left graph depicts no treatment, the middle graph depicts a control antibody (anti-DNP antibody), and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm3). Drug efficacy evaluation was conducted using mouse tumor models other than Snail+ tumor bone metastasis models. In this Example, the drug efficacy of the anti-FSTL1 antibody was evaluated using cancer-bearing models of BALB/c mice different in strain from the C57BL/6 mice used in the preceding tests.

FIG. 76B shows results about the number of metastatic nodules in the lung. The left bar depicts no treatment, the middle bar depicts a control antibody (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

Figure 77:
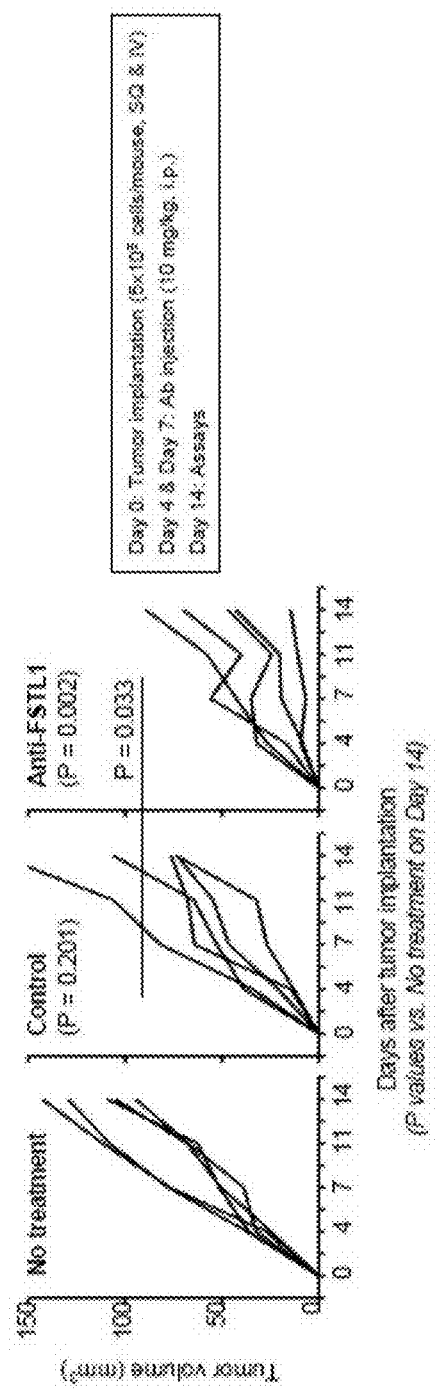

FIG. 77 also shows results of evaluating antibody activity in vivo (Example 21). This figure shows results of evaluating the drug efficacy of an anti-FSTL1 antibody using mouse breast cancer 4T1 cell-transplanted models. All of the 3 graphs show effects on tumor growth. This figure shows the tumor volume of each mouse individual (one line represents one mouse) measured 4, 7, 11, and 14 days after tumor implantation, and shows the effects of various antibodies on tumor growth. The left graph depicts no treatment, the middle graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm3). On day 0, tumor cells were transplanted ($5 \times 10^5$ cells subcutaneously & $5 \times 10^5$ cells intravenously). On days 4 and 7, the antibody was intraperitoneally administered (10 mg/kg). On day 14, drug efficacy evaluation (subcutaneous tumor growth) was conducted. The drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The growth of 4T1 subcutaneous tumor was able to be significantly suppressed by the administration of the anti-FSTL1 antibody (#6-55).

Figure 78:
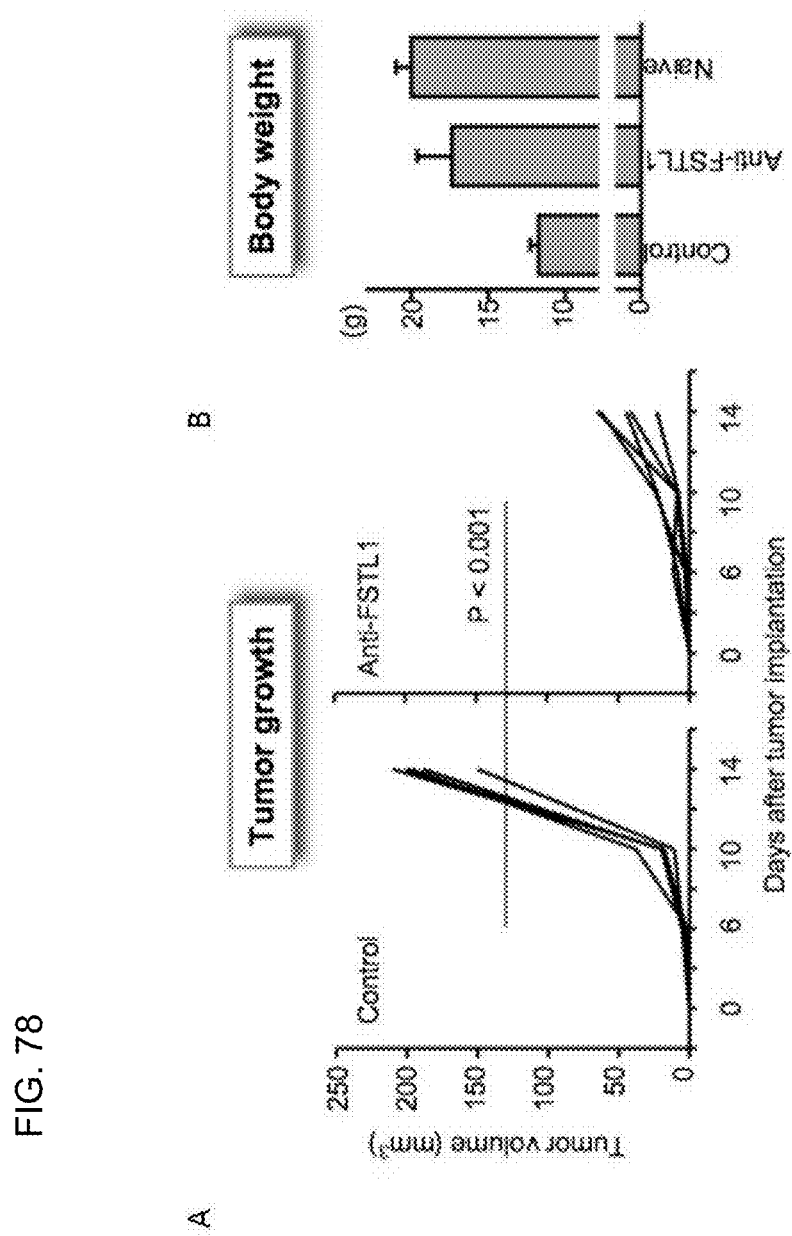

FIG. 78 Part A also shows results of evaluating antibody activity in vivo (Example 22). This figure shows results of evaluating the drug efficacy of an anti-FSTL1 antibody using mouse melanoma B16-F10. Both two graphs of the left panel show effects on tumor growth. This figure shows the tumor volume of each mouse individual (one line represents one mouse) measured 6, 10, and 14 days after tumor implantation, and shows the effects of various antibodies on tumor growth. The left graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm3). Part B shows effects on weight change. The left bar depicts a control antibody, the middle bar depicts the anti-FSTL1 antibody, and the right bar depicts an untreated individual that received no tumor cell. The ordinate shows tumor volume (g). The drug efficacy of the anti-FSTL1 antibody was evaluated using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests. Subcutaneous tumor growth was strongly suppressed by the administration of the anti-FSTL1 antibody (#6-55), as compared with the control antibody administration group. Also, suppressive activity against weight loss was also exhibited.

Figure 79:
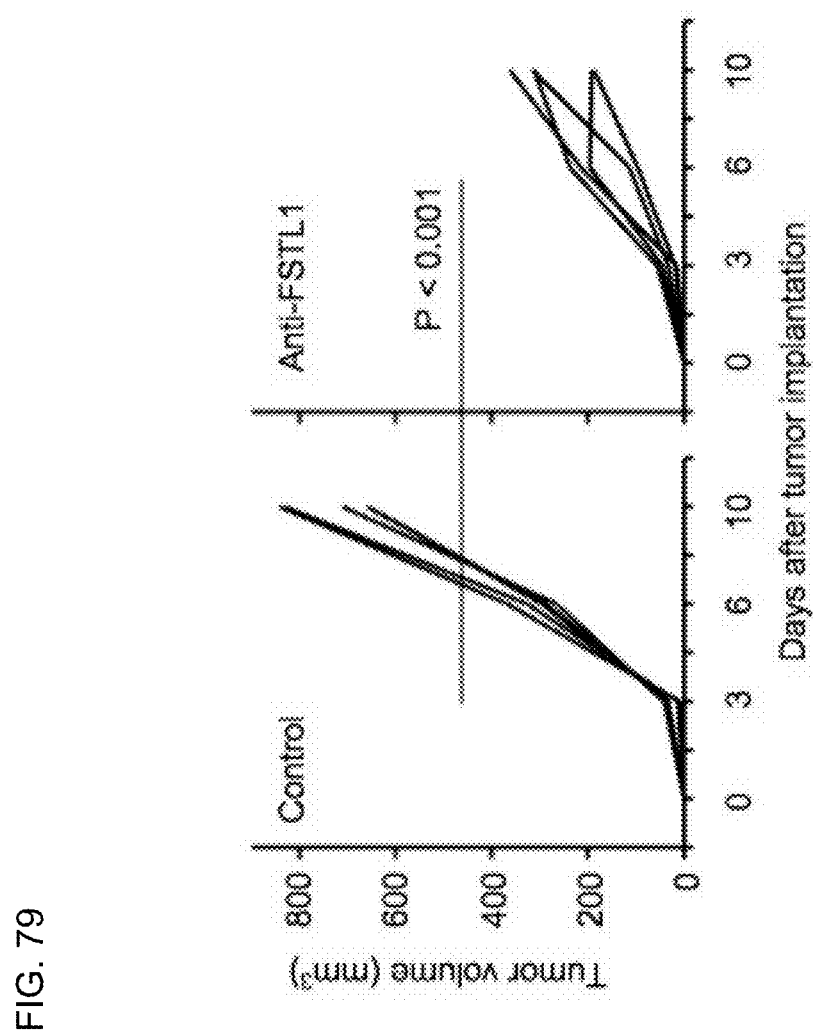

FIG. 79 also shows results of evaluating antibody activity in vivo (Example 23). This figure shows results of evaluating the drug efficacy of an anti-FSTL1 antibody using mouse lymphoma EL4. Both two graphs show effects on tumor growth. This figure shows the tumor volume of each mouse individual (one line represents one mouse) measured 3, 6, and 10 days after tumor implantation, and shows the effects of various antibodies on tumor growth. The left graph depicts a control antibody, and the right graph depicts the anti-FSTL1 antibody. The numerical values within the parentheses and the numerical values on the lines (indicated by P) represent p values regarding statistical significance (day 14). The abscissa shows the number of days. The ordinate shows tumor volume (mm3). The drug efficacy of the anti-FSTL1 antibody was evaluated using mouse lymphoma EL4, which is a cancer type having enhanced FSTL1 expression. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group.

Figure 80:
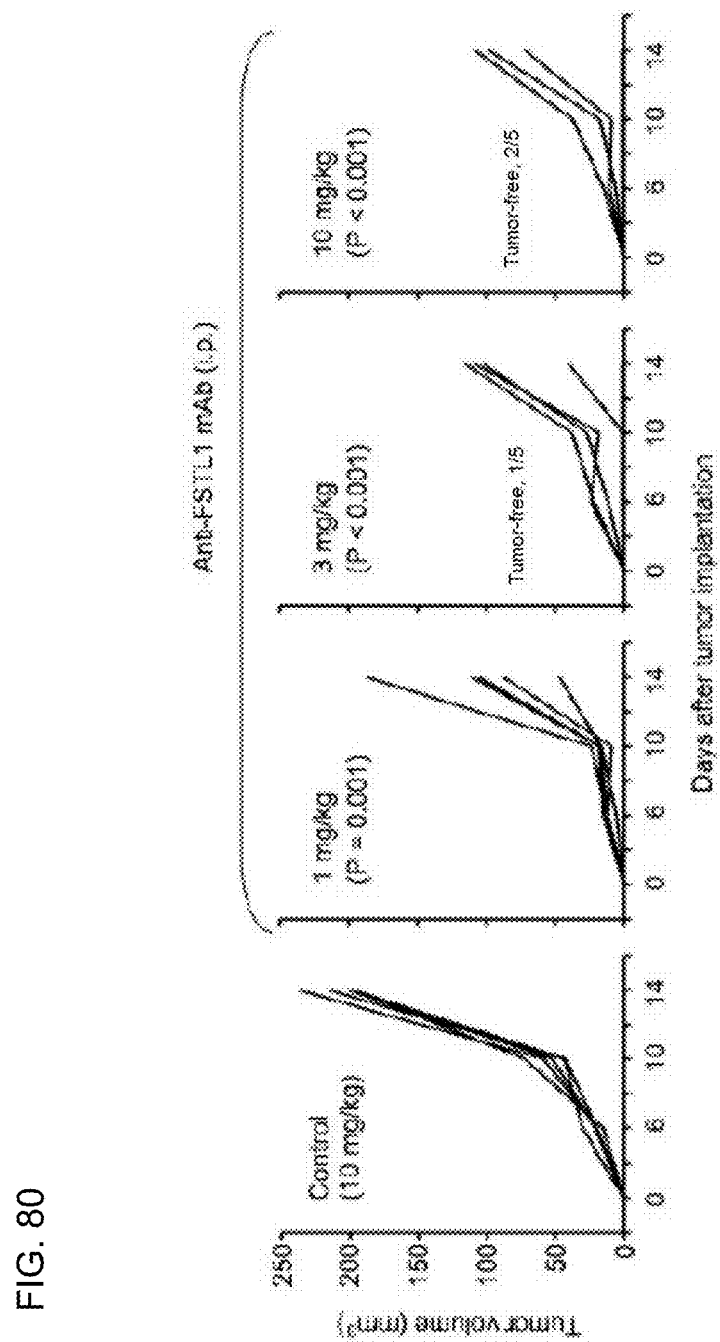

FIG. 80 also shows results of evaluating antibody activity in vivo (Example 24). This figure shows results of evaluating the drug efficacy of an anti-FSTL1 antibody using mouse melanoma B16-F10. All of the 4 graphs show effects on tumor growth. This figure shows the tumor volume of each mouse individual (one line represents one mouse) measured 6, 10, and 14 days after tumor implantation, and shows the effects of various antibodies on tumor growth. The leftmost graph depicts a control antibody, the second graph from the left depicts 1 mg/kg of the anti-FSTL1 antibody, the second graph from the right depicts 3 mg/kg of the anti-FSTL1 antibody, and the rightmost graph depicts 10 mg/kg of the anti-FSTL1 antibody. The numerical values within the parentheses and the numerical values on the lines (indicated by P) represent p values regarding statistical significance (day 14). The abscissa shows the number of days. The ordinate shows tumor volume (mm3). The drug efficacy of the anti-FSTL1 antibody was evaluated in the same test system as in the experiment illustrated in FIG. 78 except that only subcutaneous transplantation was performed here in order to more clearly evaluate reactivity. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Figure 81:
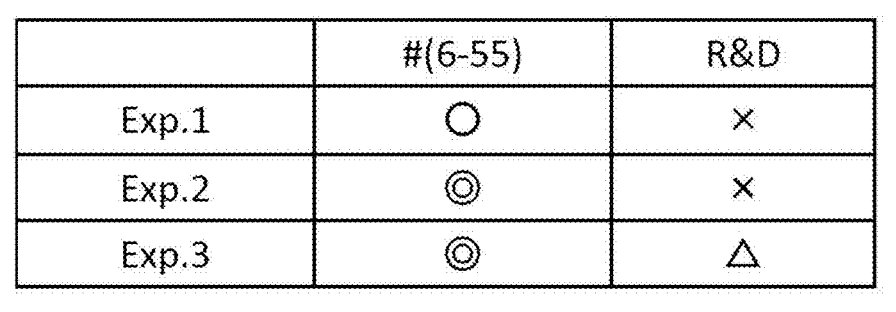

FIG. 81 shows results of a Treg induction experiment in which activity was measured with % CD4+ Foxp3+CTLA+ cells as an index in an experimental system involving the anti-FSTL1 antibody (#6-55) of the present invention and a known anti-FSTL1 antibody (R&D Systems, Inc., Cat. No. MAB1694, clone 229007). The double circle, the circle, and the triangle depict statistical significance and represent 30% or more decrease, 10% to 30% decrease, and less than 10% decrease, respectively. The cross mark represents the absence of statistically significant difference.

Figure 82:
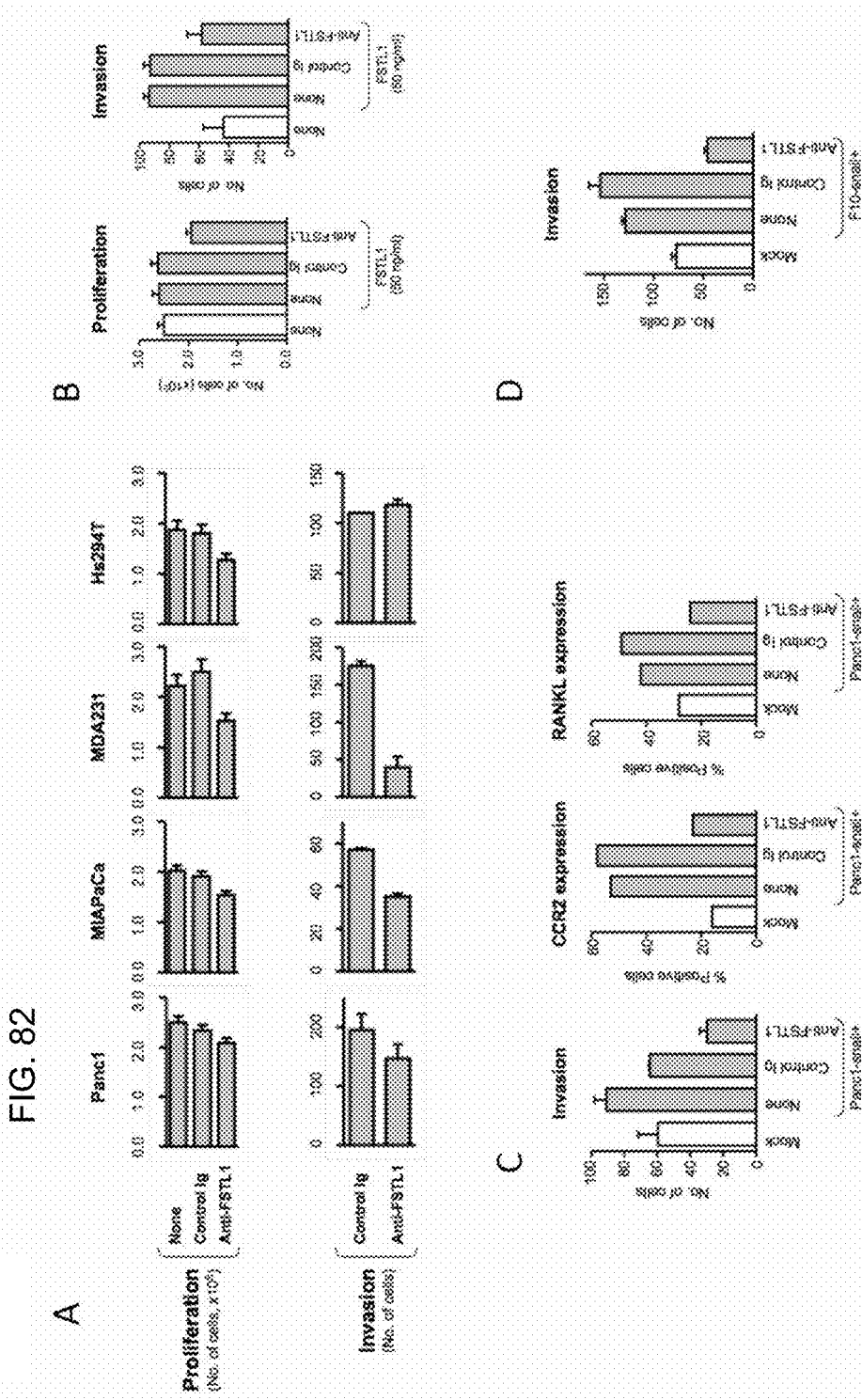

FIG. 82 shows results of examining various functions of an anti-FSTL1 antibody. Panel A shows the influence of the anti-FSTL1 antibody on the proliferative capacity and invasive capacity of various human tumor cells. The upper graphs of panel A show the results about proliferation, and the lower graphs show the results about invasion. Pancl, MIAPaCa, MDA231, and Hs294 are depicted from the left to the right. The upper graphs show the number of cells ($\times 10^3$) after culture for 3 days. The lower graphs show the number of tumor cells treated with the antibody for 3 days. In each of the upper graphs, none, control IgG, and the anti-FSTL1 antibody are depicted from the upper to lower bars. In each of the lower graphs, the upper bar depicts control IgG, and the lower bar depicts the anti-FSTL1 antibody. These results demonstrated that Snail+ tumor cells have very high metastatic properties. Panel B shows the action of the anti-FSTL1 antibody under FSTL1 stimulation. The left graph shows proliferative capacity, and the right graph shows invasive capacity. In both graphs, the left bar depicts none, and the second to fourth bars from the left depict none, mouse IgG, and the anti-FSTL1 antibody (#6-55) in order in the presence of FSTL1 (50 ng/ml). Panels C and D show the action of the anti-FSTL1 antibody on cells forced to express Snail. Panel C shows the results about Matrigel invasion, CCR2 expression, and RANKL expression from the left to the right. In all of the graphs, the left bar depicts Panel cells of a parent line that were not forced to express Snail (Mock), and the second bar from the left to the rightmost bar depict none, mouse IgG, and the anti-FSTL1 antibody (#6-55) in order in the presence of the anti-FSTL1 antibody (50 ng/ml). Panel D shows results obtained in Snail transfectants of mouse melanoma B16t-F10. In the graph, the left bar depicts a false antibody (Mock), and the second bar from the left to the rightmost bar depict none, mouse IgG, and the anti-FSTL1 antibody (#6-55) in order in the presence of FSTL1 (50 ng/ml).

Figure 83:
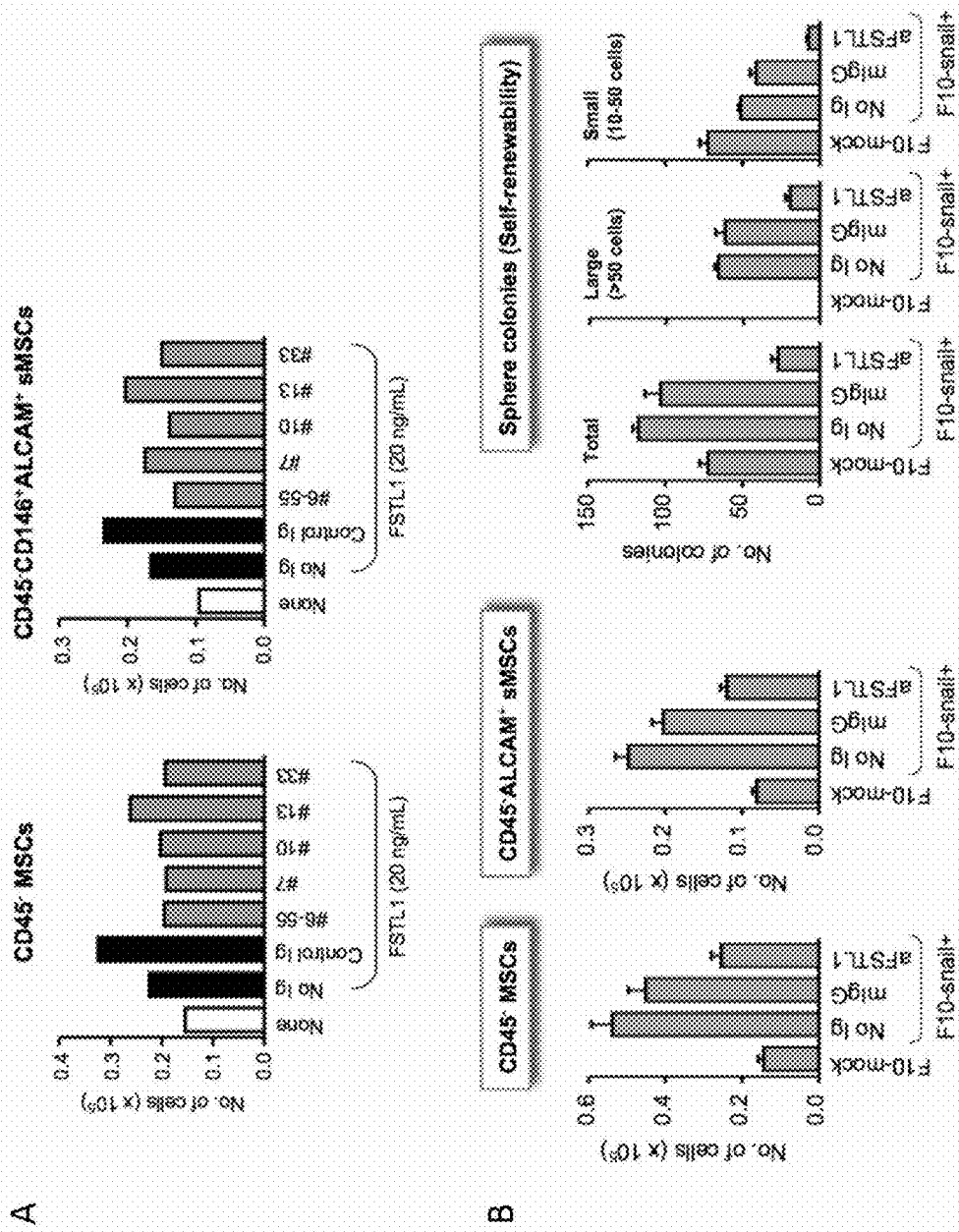

FIG. 83 shows results of a MSC induction inhibition test using mouse bone marrow cells. In panel A, the left graph depicts CD45+ MSC cells, and the right panel depicts CD45+CD146+ALCAM+sMSCs. The left bar depicts none, and the second bar from the left to the rightmost bar show results obtained in FSTL1 (20 ng/ml) and depict no immunoglobulin, mouse immunoglobulin, and the antibody #6-55, #7, #10, #13, and #33 of the present invention in order. Panel B depicts CD45− MSC cells, CD45-ALCAM+ sMSC cells, and sphere colonies (self-renewability). The leftmost bar depicts F10-mock, and the second bar from the left to the rightmost bar depict F10-snail+. Results about no immunoglobulin, mouse immunoglobulin, and the anti-FSTL1 antibody are shown in order from the second bar from the left. The results are indicated by the number of cells in the left and middle graphs. The sphere colonies represent the number of colonies. Among the 3 graphs of the sphere colonies, the left graph shows the total number, the middle graph shows large colonies (>50 cells), and the right graph shows small colonies (10 to 50 cells).

Figure 84:
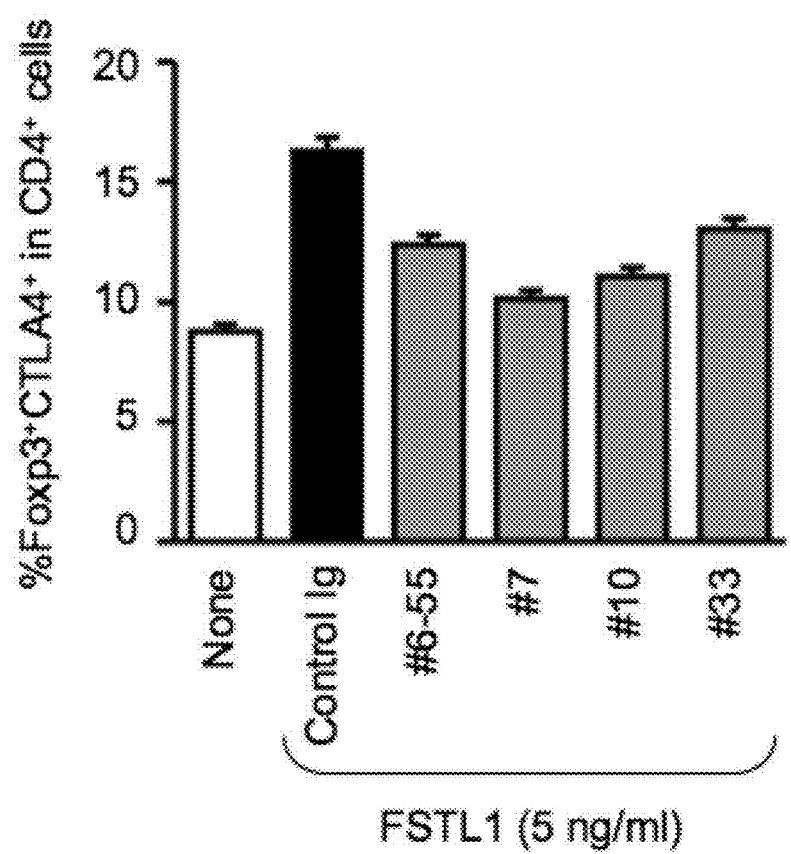

FIG. 84 shows results of a Treg induction inhibition test using mouse spleen cells. The graph shows the percentage of Foxp3+CTLA4+ cells in CD4+ cells. The leftmost bar depicts none, and the second bar from the left to the rightmost bar show results of the experiment in the presence of FSTL (5 ng/ml). Mouse immunoglobulin, and the antibody #6-55, #7, #10, and #13 of the present invention are depicted in order from the second bar from the left.

Figure 85:
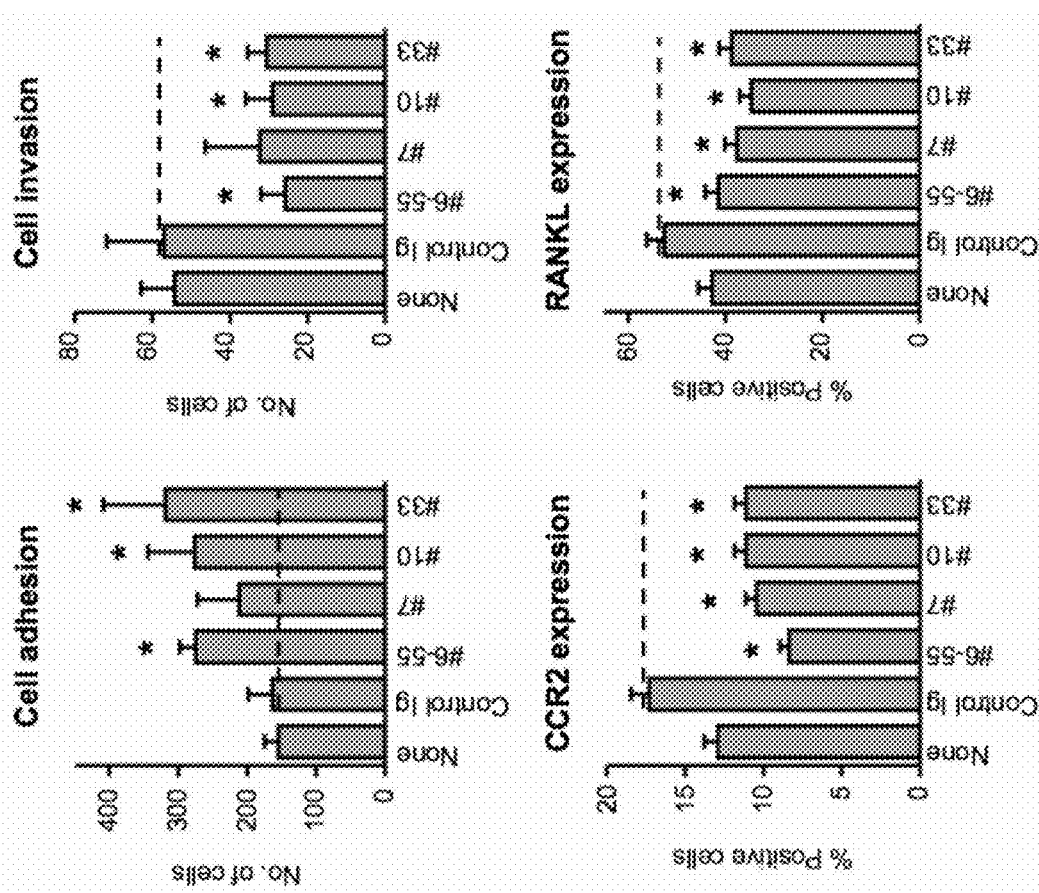

FIG. 85 shows results of evaluating newly prepared 3 anti-FSTL1 antibodies (#7, #10, and #33) differing in epitope for their inhibitory activity against mouse tumor activation. The upper left graph shows cell adhesion, the upper right graph shows cell invasion, the lower left graph shows CCR2 expression, and the lower right graph shows RANKL expression. In each graph, none, control immunoglobulin, and the antibody #6-55, #7, #10, and #33 of the present invention are depicted from the left to the right. * represents statistical significance ($p<0.05$).

Figure 86A:
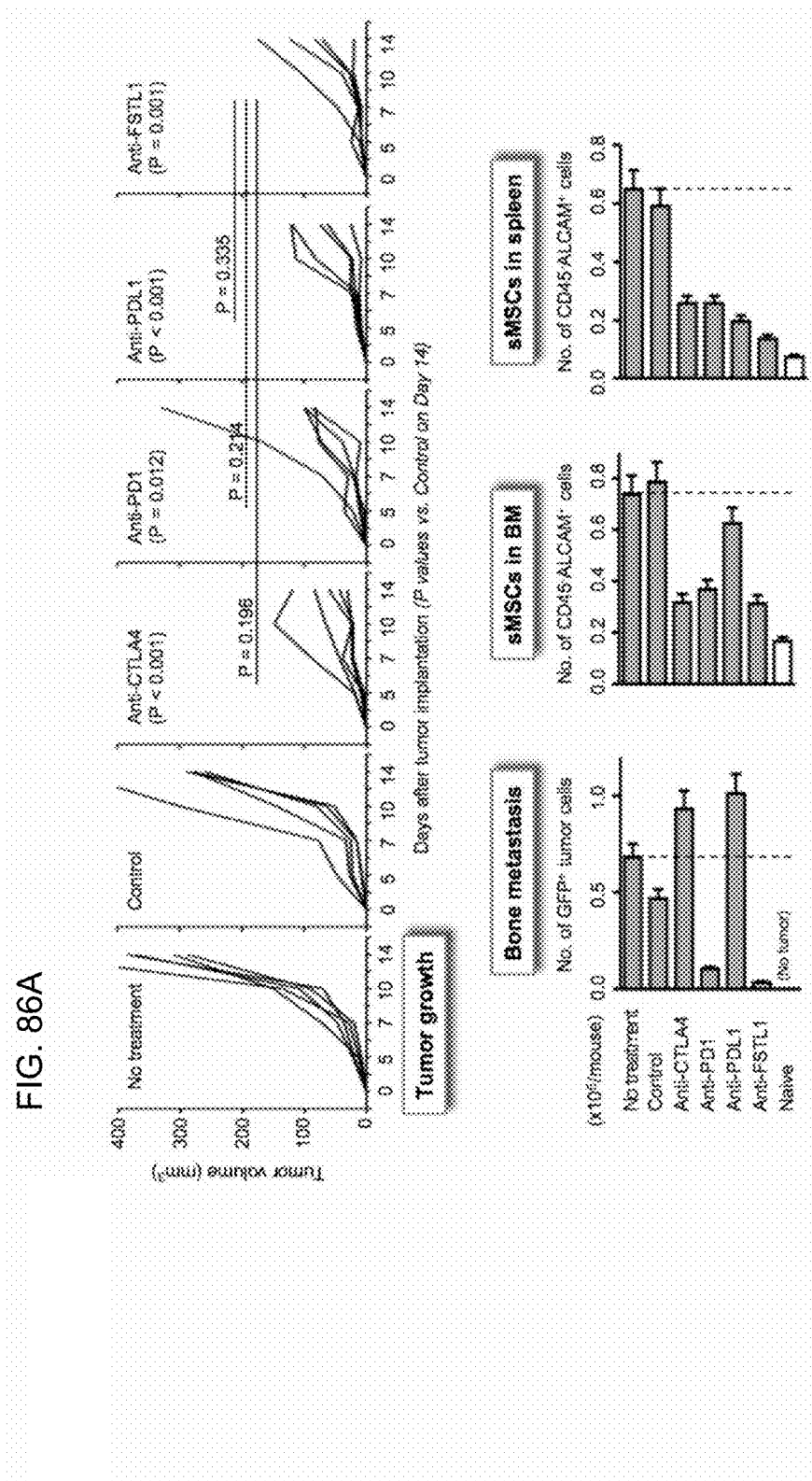

FIGS. 86A to 86D show results of comparing in vivo drug efficacy between antibody drugs for immune mitigation already used clinically and an anti-FSTL1 antibody using Snail+ tumor bone metastasis models. In FIG. 86A, the upper graphs show tumor growth, and the lower graphs show bone metastasis, sMSCs in bone marrow, and sMSCs in the spleen. In the upper graphs of the tumor growth, no treatment, a control, an anti-CTLA4 antibody, an anti-PD1 antibody, an anti-PD-L1 antibody, and the anti-FSTL1 antibody are depicted from the left to the right. Statistical significance is indicated by p value. The x-axis shows the number of days after tumor implantation (the p values are values of day 14). The y-axis shows tumor volume (mm3). As for the bone metastasis and two sMSC grafts, no treatment, a control, an anti-CTLA4 antibody, an anti-PD1 antibody, an anti-PD-L1 antibody, the anti-FSTL1 antibody, and naive (non-tumor model) are also depicted from the upper to lower bars. The abscissas show the number of GFP+ tumor cells, the number of CD45-ALCAM+ cells, and the number of CD45-ALCAM+ cells, respectively.

Figure 86B:
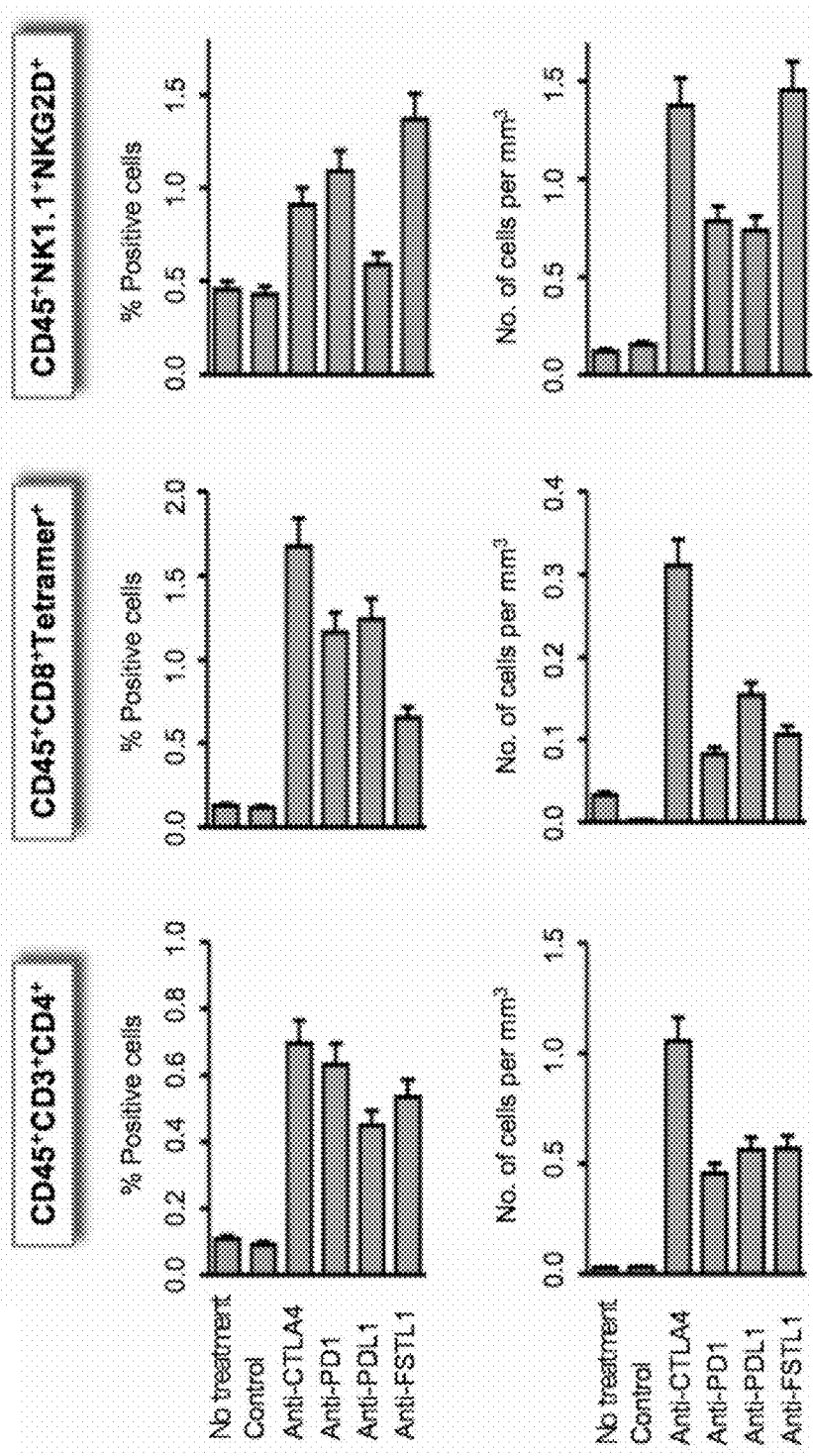

FIG. 86B shows cell groups in charge of antitumor immunity that invaded tumor. CD4+ T cells (CD45+CD3+ CD4+ cells), tumor-specific CD8+ T cells (CD45+CD8+ tetramer+), and activated NK cells (CD45+NK1.1+ NKG2D+) are depicted from the left to the right. The upper graphs show the percentage of positive cells. The lower graphs show the number of cells per mm3. In each graph, no treatment, a control, an anti-CTLA4 antibody, an anti-PD1 antibody, an anti-PD-L1 antibody, and the anti-FSTL1 antibody are depicted from the upper to lower bars.

Figure 86C:
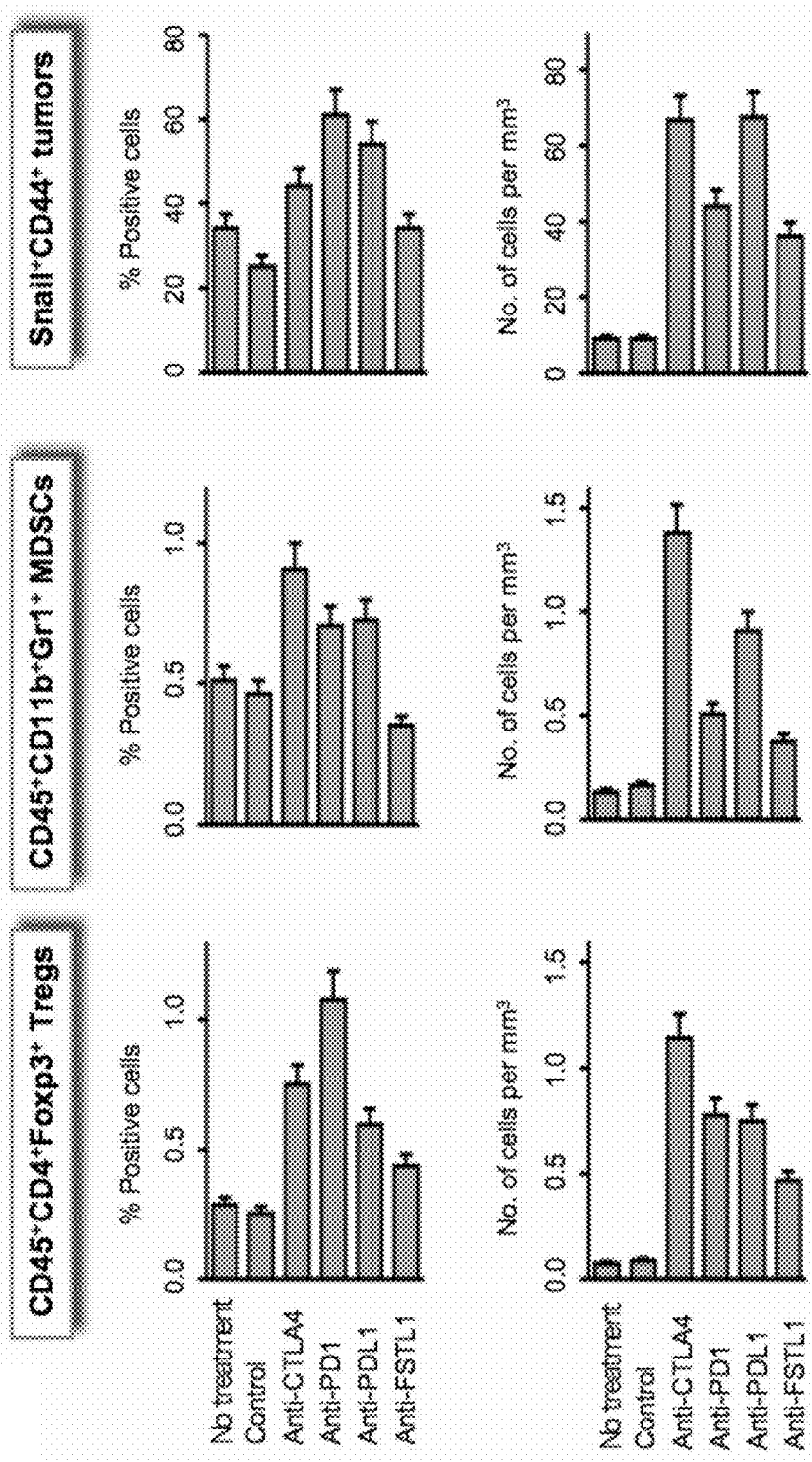

FIG. 86C shows results of the same experiment as in FIG. 86B and shows the results about an immunosuppressive T cell group that invaded tumor and highly metastatic tumor cells in subcutaneous tumor. CD4+ Tregs (CD45+CD4+ Foxp3+ Tregs), MDSCs (CD45+CD11b+Gr1+ MDSCs), and tumor cells having EMT (Snail+CD44+ tumors) are depicted from the left to the right. The description of the graphs is the same as in FIG. 86B. No treatment, a control, an anti-CTLA4 antibody, an anti-PD1 antibody, an anti-PD-L1 antibody, and the anti-FSTL1 antibody are depicted from the upper to lower bars.

Figure 86D:
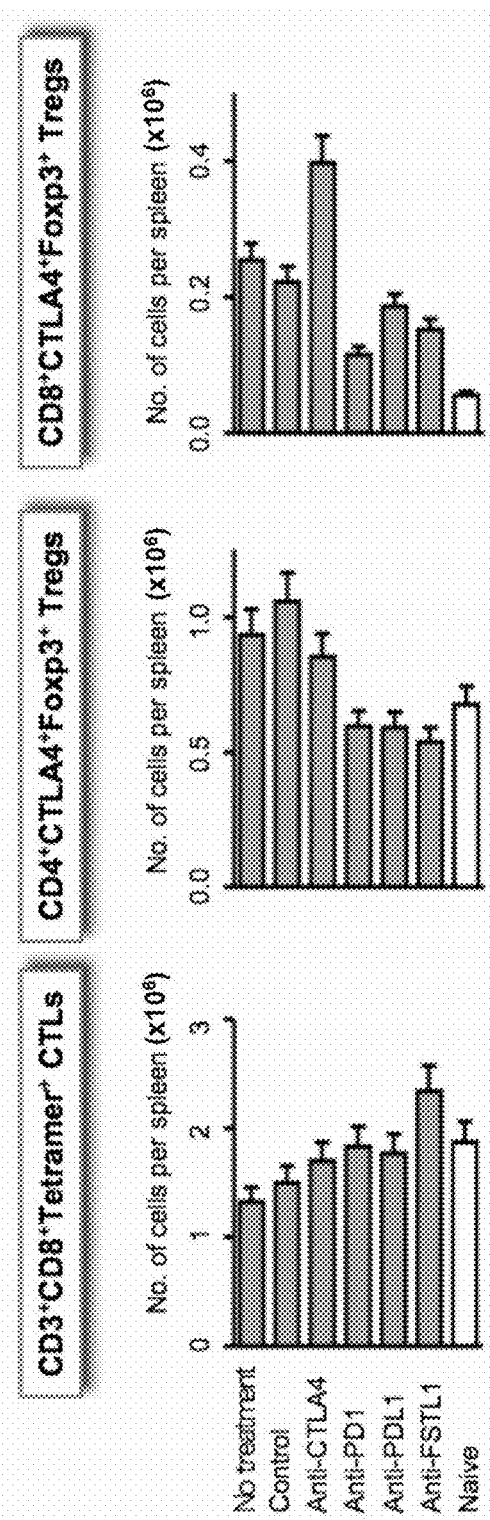

FIG. 86D shows results obtained in immunocyte groups in the spleen. Tumor-specific CD8+ T cells (CD3+CD8+ tetramer+ CTLs), CD4+ Tregs (CD4+CTLA4+ Foxp+ Tregs), and CD8+ Tregs (CD8+CTLA4+ Foxp3+ Tregs) are depicted from the left to the right. The graphs show the number of cells per spleen (indicated by ×10$^6$). No treatment, a control, an anti-CTLA4 antibody, an anti-PD1 antibody, an anti-PD-L1 antibody, and the anti-FSTL1 antibody are depicted from the upper to lower bars.

Figure 87:
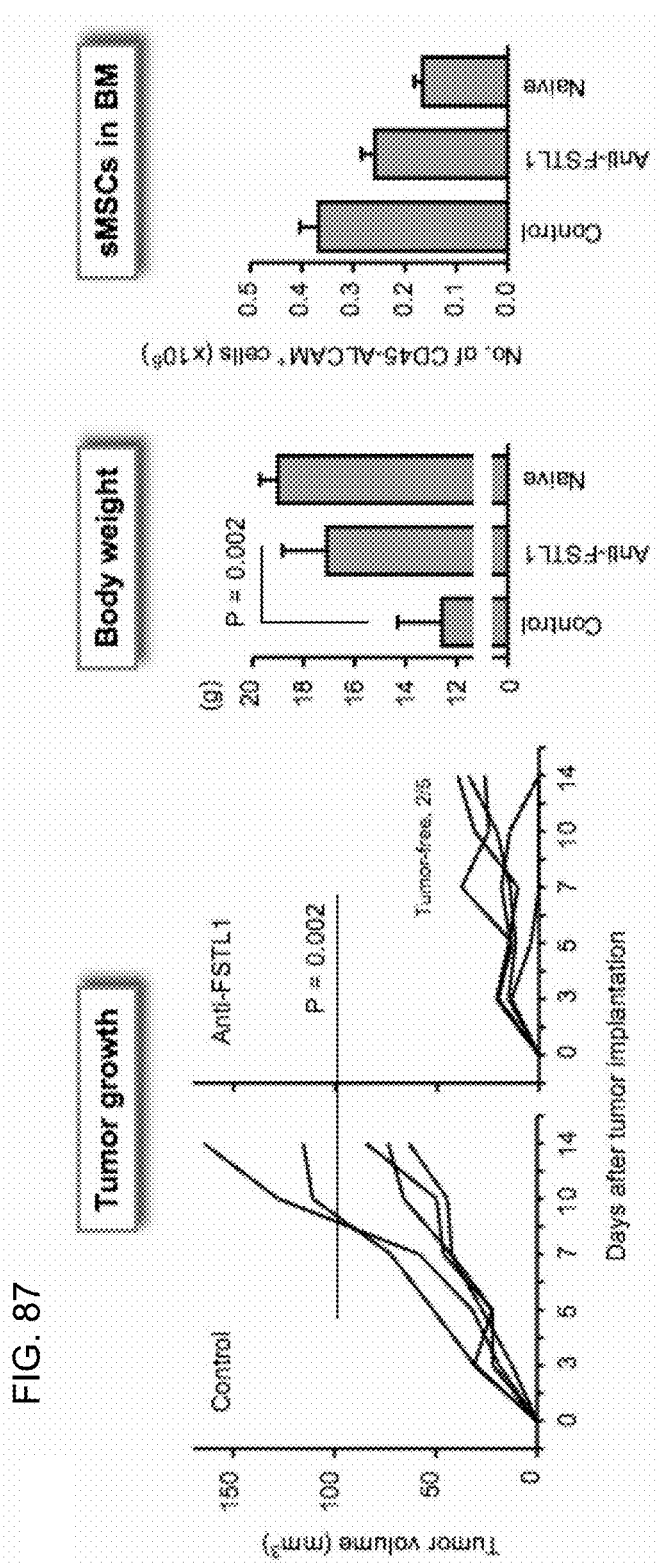

FIG. 87 shows results of evaluating drug efficacy (tumor growth, body weight, and the number of sMSCs in bone marrow) using mouse lung cancer models. For the tumor growth, statistical significance is indicated by p value. A control is depicted on the left, and an anti-FSTL1 antibody is depicted on the right. The abscissa shows the number of days after tumor implantation. The ordinate shows tumor volume (mm3). The middle graph shows animal body weight. A control, an antibody FSTL1 antibody, and naive are depicted from the left to the right. The body weight is indicated by g. The right graph shows sMSCs in bone marrow. A control, an anti-FSTL1 antibody, and naive are depicted from the left to the right. The number of CD45-ALCAM+ cells (×10$^6$) is shown.

Figure 88:
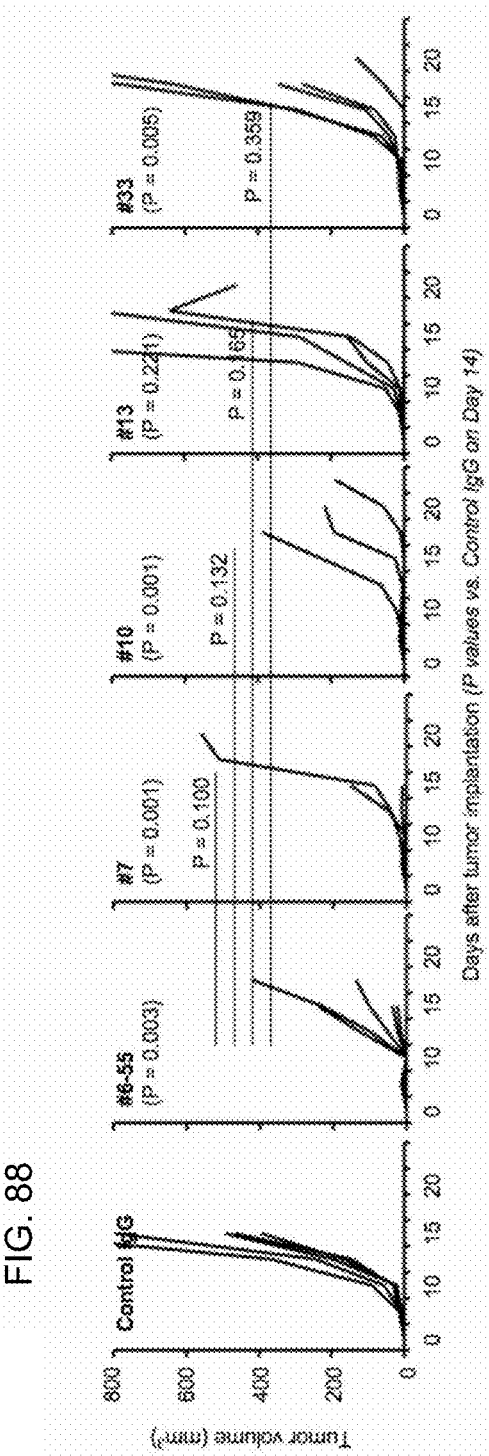
Figure 89:
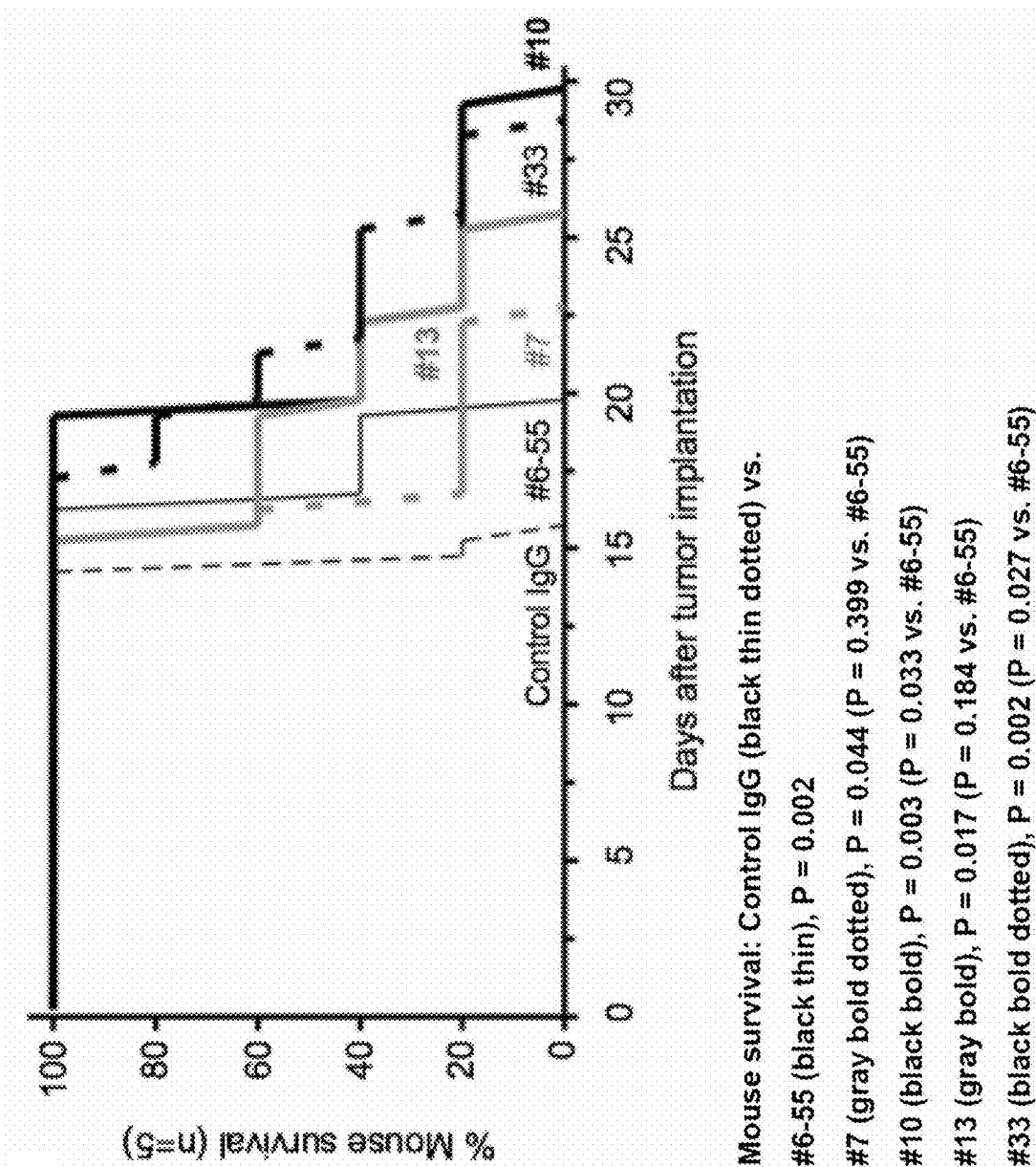

FIG. 88 FIGS. 88 and 89 show the results of evaluating the in vivo drug efficacy of each anti-FSTL1 antibody clone using Snail+ tumor bone metastasis models. FIG. 88 shows change in tumor volume (mm3) after tumor implantation. The results about control immunoglobulin and the antibody #6-55, #7, #10, #13, and #33 of the present invention are shown from the left to the right. Statistical significance (p value) compared with a control is indicated within parentheses, and statistical significance vs. #6-55 is connected by a line and indicated by p value. The abscissa shows the number of days after tumor implantation.

FIG. 89 FIGS. 88 and 89 show the results of evaluating the in vivo drug efficacy of each anti-FSTL1 antibody clone using Snail+ tumor bone metastasis models. FIG. 89 shows survival rate. The abscissa shows the number of days after tumor implantation. The ordinate shows mouse survival rate (n=5). The results about control immunoglobulin and the antibody #6-55, #7, #10, #13, and #33 of the present invention are shown. Statistical significance values (p value) vs. the control immunoglobulin are indicated by black thin dotted line for #6-55, gray bold dotted line for #7, black bold line for #10, gray bold line for #13, and black bold dotted line for #33 with statistical significance (p value) vs. #6-55 indicated within parentheses.

Figure 90:
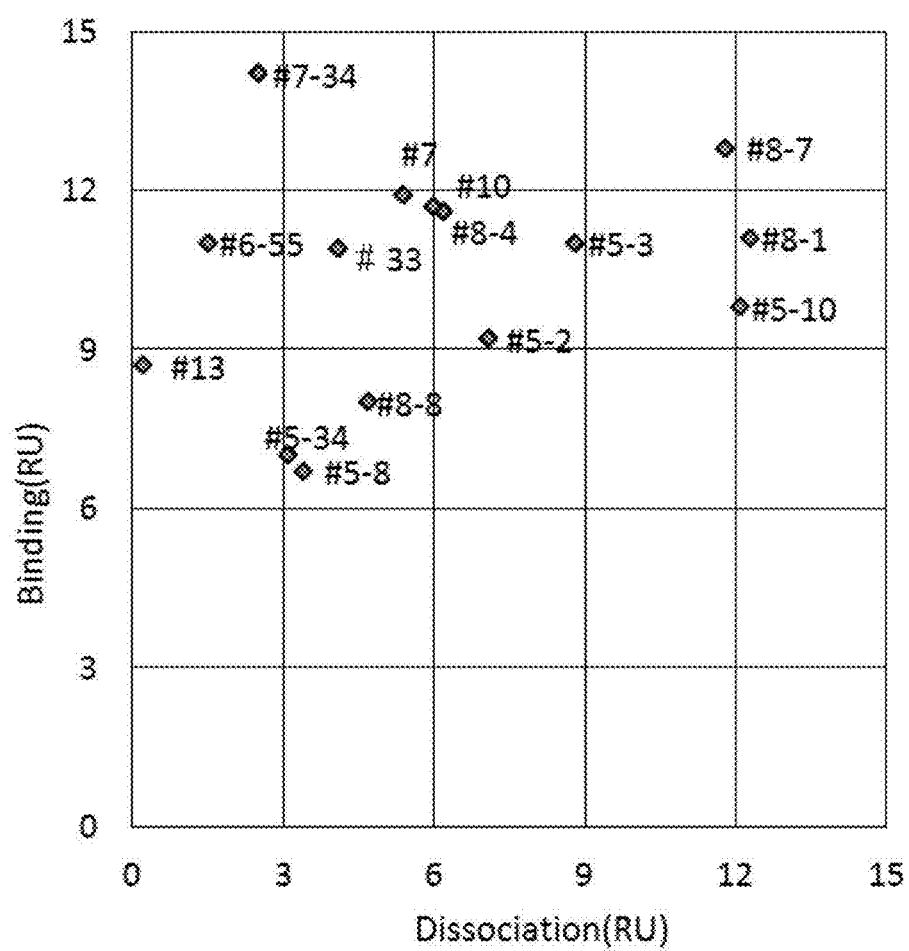

FIG. 90 shows affinity data (determined by BIACORE) on mouse chimeric antibodies. The figure is a plot of the antigen binding amounts and dissociation amounts of the mouse chimeric antibodies.

Figure 91:
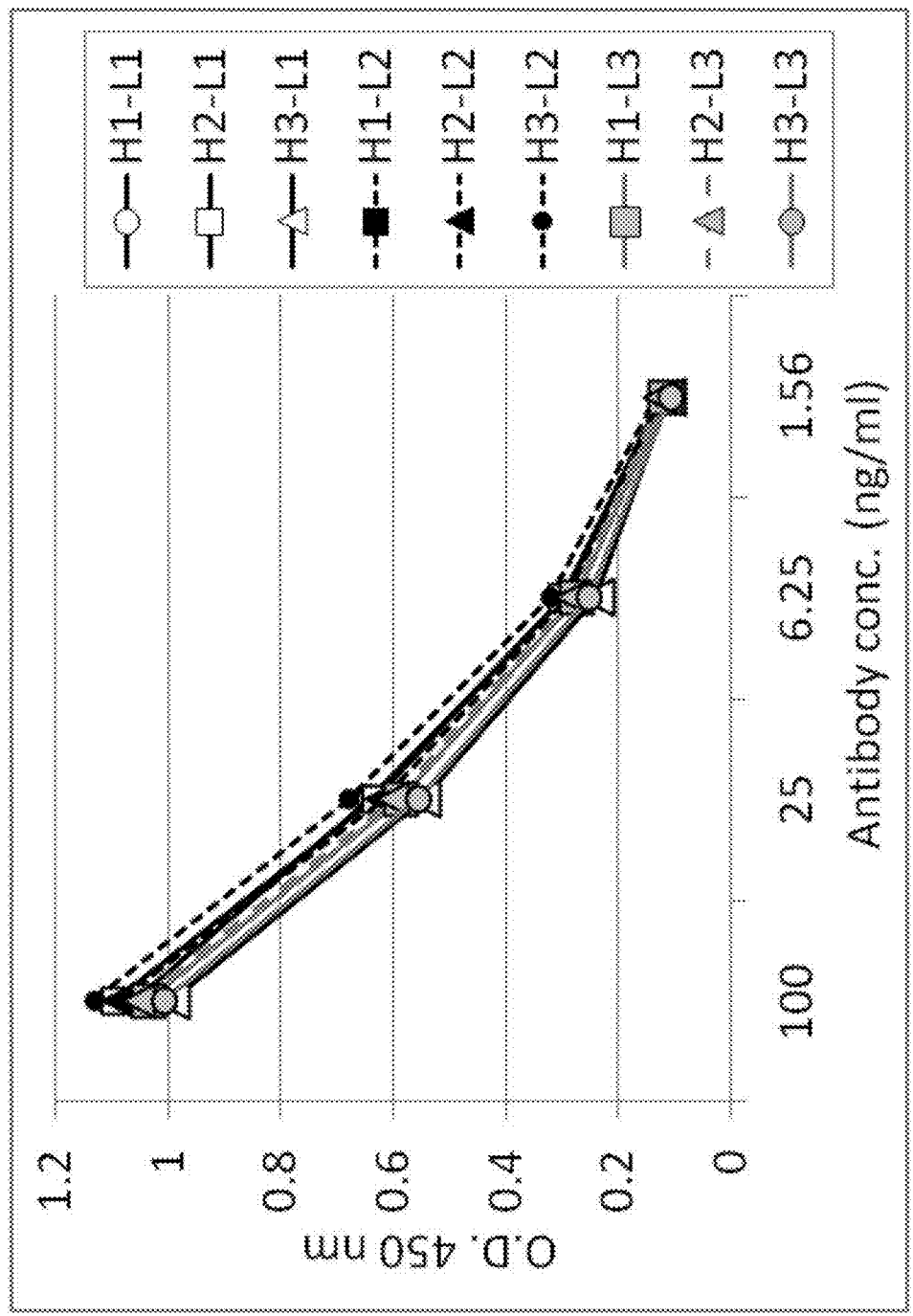
Figure 92:
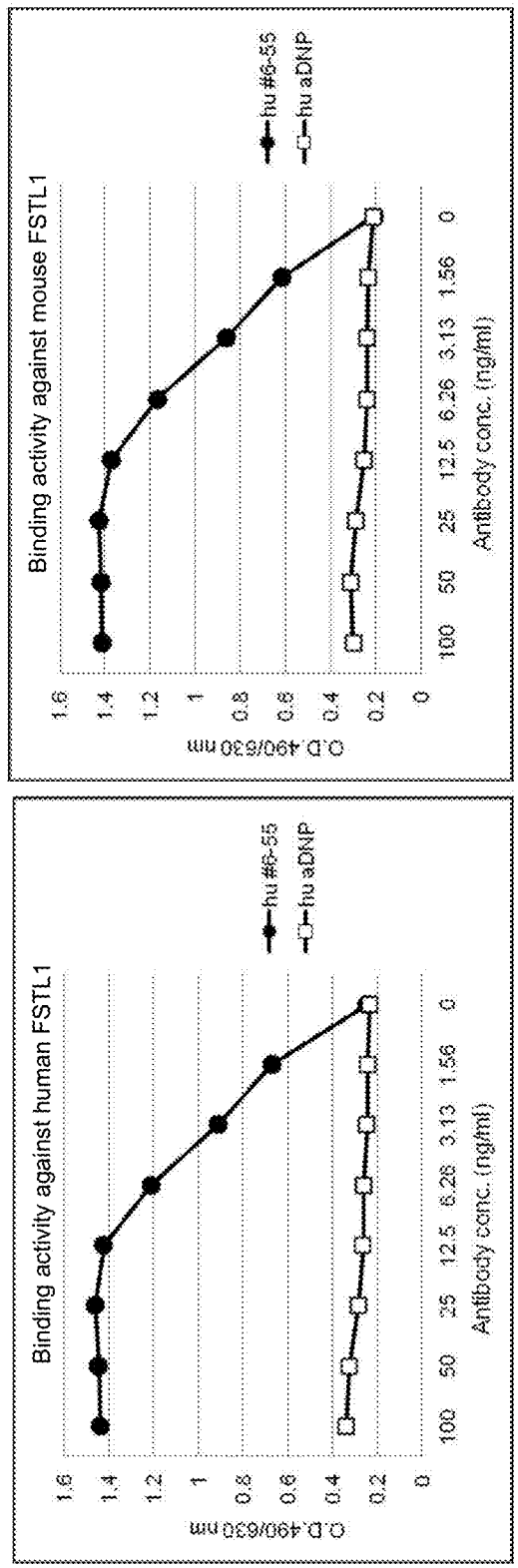

FIG. 91 FIGS. 91 and 92 show results of humanized antibodies. FIG. 91 shows results of comparing binding activity using combinations of humanized 6-55 antibody H chains (IgG1 type) and L chains. The open circle with the dotted line shows the results about humanized antibody H1-L1, the square with the bold line shows the results about H2-L1, the open triangle with the bold line shows the results about H3-L1. Antibody concentrations are indicated on the abscissa, and OD450 values are indicated. H2-L1 was found to be best.

FIG. 92 FIGS. 91 and 92 show results of humanized antibodies. FIG. 92 shows the binding activity of humanized #6-55 H2-L1 (IgG1 type) of the antibody of the present invention against human and mouse FSTL1. The left graph shows the binding activity against human FSTL1, and the right graph shows the binding activity against mouse FSTL1. In both graphs, the filled circle depicts a human #6-55 antibody, and the open square depicts a human anti-DNP antibody. Antibody concentrations are indicated on the abscissa, and OD490/630 values are indicated.

Figure 93:
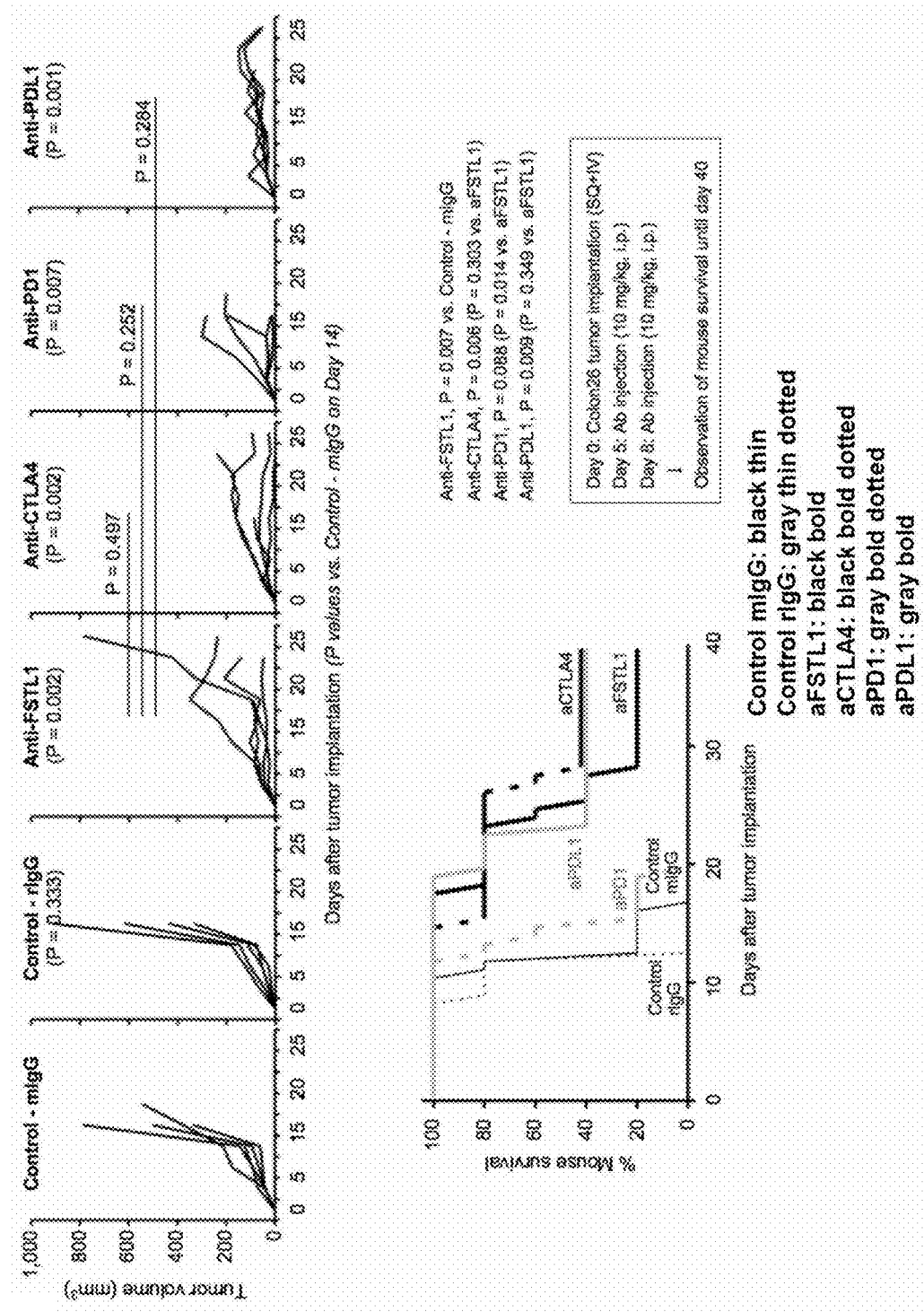

FIG. 93 is a diagram showing results of comparing in vivo activity with existing antibody drugs for mitigation of immunosuppression in Colon26 lung metastasis models. This figure shows drug efficacy evaluation in which an anti-FSTL1 antibody, an anti-CTLA4 antibody, an anti-PD1 antibody, and an anti-PD-L1 antibody were compared as single agents (Example 37). Mouse immunoglobulin (control), rat immunoglobulin (control), the antibody FSTL1 antibody, the anti-CTLA4 antibody, the anti-PD-1 antibody, and the anti-PD-L1 antibody are depicted from the left to the right. The ordinate shows tumor volume. The abscissa shows the number of days after tumor implantation. The numerical values within the parentheses and the numerical values on the lines (indicated by P) represent p values regarding statistical significance (day 14).

The lower panel shows survival rate. The control rat IgG is indicated by gray thin dotted line, the control mouse IgG is indicated by black thin line, the anti-PD1 antibody is indicated by gray bold dotted line, and the antibody PD-L1 antibody is indicated by gray bold line. The anti-FSTL1 antibody is indicated by black bold line, and the anti-CTLA4 antibody is indicated by black bold dotted line.

Figure 94:
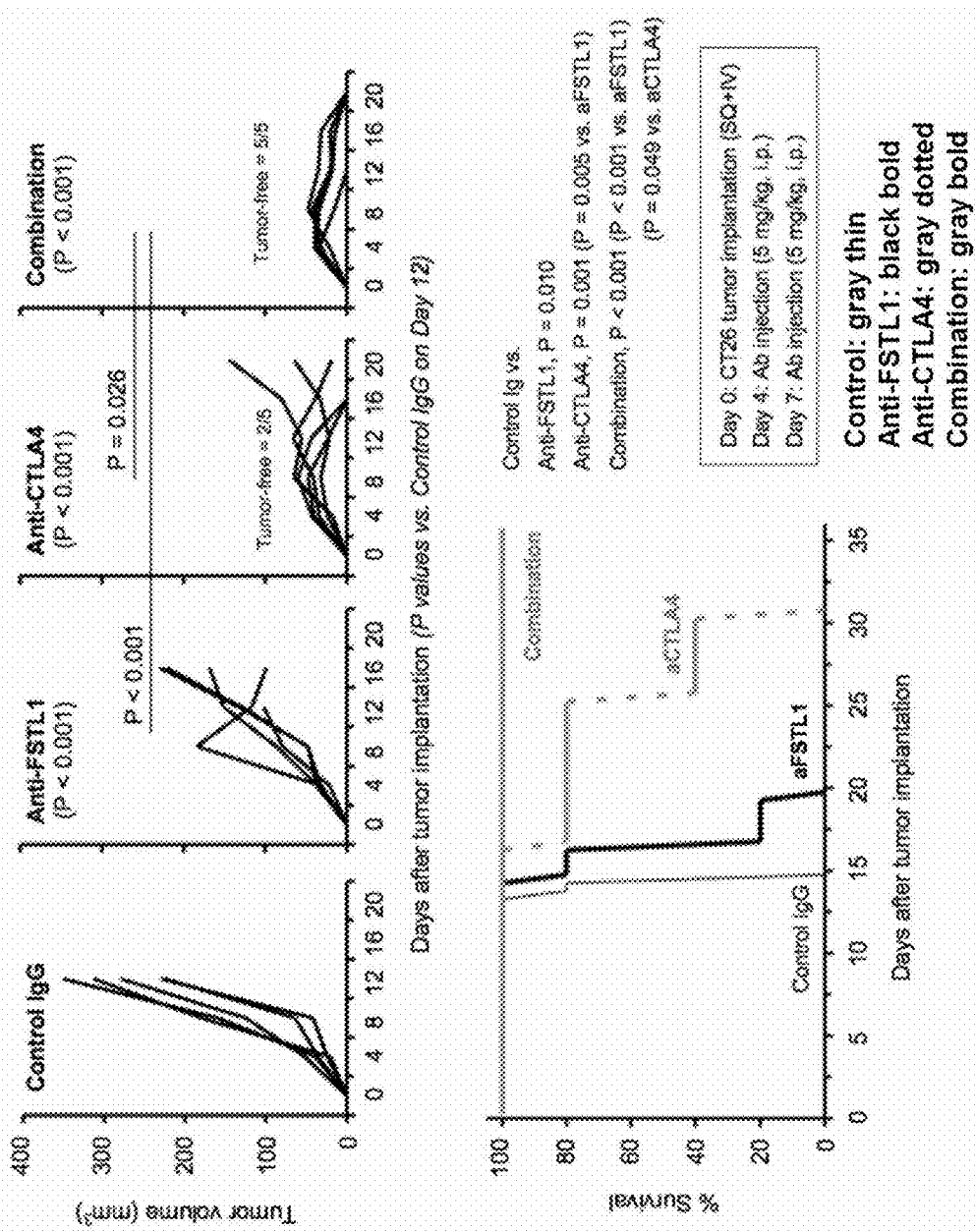

FIG. 94 shows results about effects brought about by combined use with an anti-CTLA4 antibody using CT26-transplanted models. The left graphs of the upper panel respectively show the drug efficacy evaluation of immunoglobulin (control), an anti-FSTL1 antibody, and an anti-CTLA4 antibody as single agents, and the rightmost graph shows the drug efficacy evaluation of a combination drug of the anti-FSTL1 antibody and the anti-CTLA antibody (Example 38). The ordinate shows tumor volume. The abscissa shows the number of days after tumor implantation. The numerical values within the parentheses and the numerical values on the lines (indicated by P) represent p values regarding statistical significance (day 14).

The lower panel shows survival rate. The ordinate shows survival rate. The abscissa shows the number of days after tumor implantation. Surprisingly, there was no dead case from the combination therapy even after a lapse of 35 days. The control IgG is indicated by gray thin line, and the anti-FSTL1 antibody is indicated by black bold line. The anti-CTLA4 antibody is indicated by gray dotted line, and the combination is indicated by gray bold line indicating 100% constantly.

Figure 95:
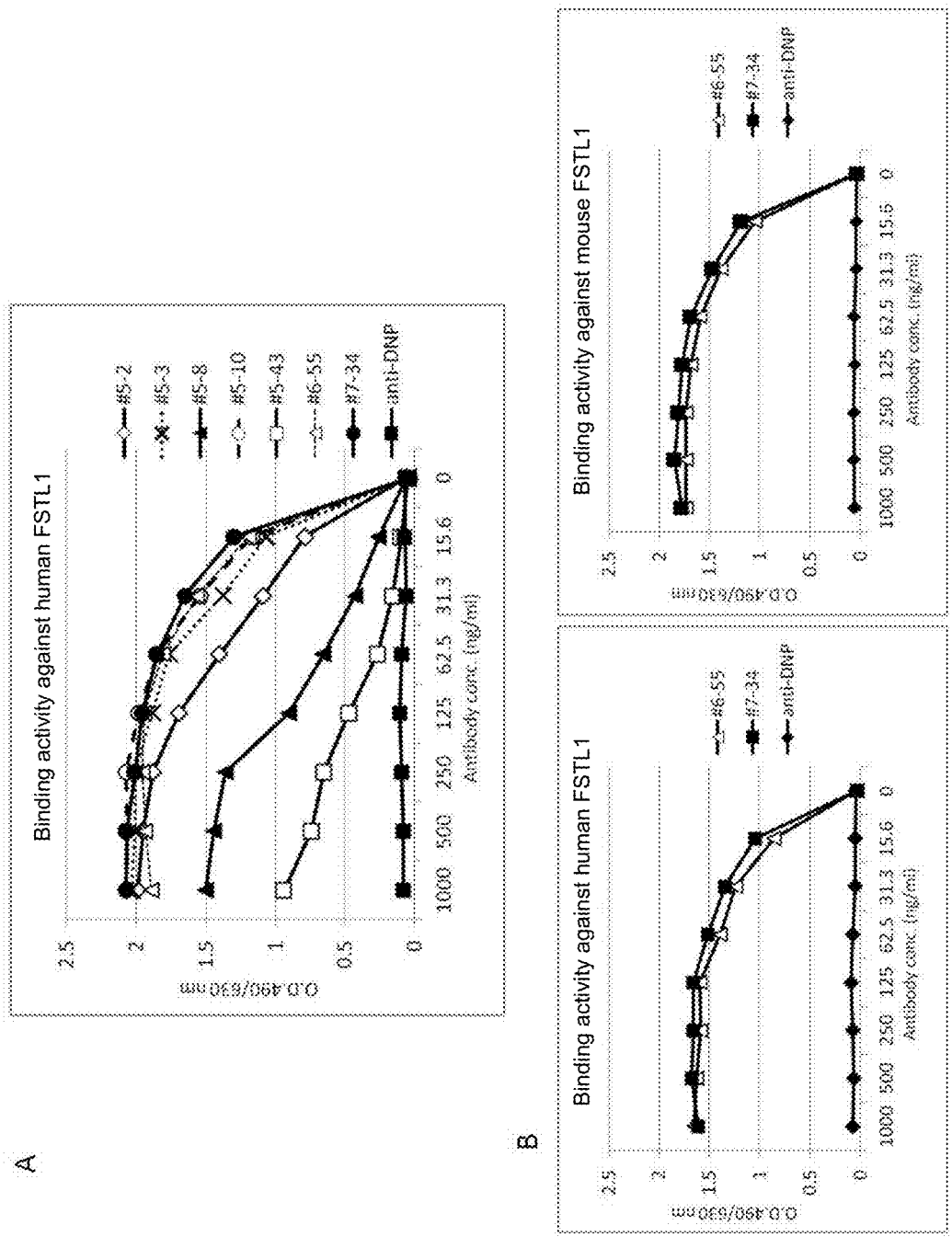

FIG. 95 is graphs showing the binding activity of the antibody of the present invention against FSTL1 (Example 2). Part A shows results of evaluating the binding activity of clones obtained by initial screening against human FSTL1 by ELISA. The open rhomboid depicts clone #5-2, the cross mark depicts clone #5-4, the filled triangle depicts clone #5-8, the open circle depicts clone #5-10, the open square depicts clone #5-43, the open triangle depicts clone #6-55, the filled circle depicts clone #7-34, and the filled square depicts a control anti-dinitrophenyl (DNP) antibody. The strength of the binding activity was #5-10, #6-55, and #7-34>#5-3>#5-8>#5-43. Part B shows results of examining the cross reactivity between mice and humans. Among the antibodies shown in Part A, clones that also exhibited reactivity with mouse FSTL1 in the screening were evaluated for their binding activity. The binding activity against human FSTL1 is shown on the left, and the binding activity against mouse FSTL1 is shown on the right. Both #6-55 and #7-34 exhibited strong binding activity against human and mouse FSTL1. In FIG. 95, the antibody concentration was diluted from 1000 ng/ml. For experiments shown in FIG. 96 or subsequent figures, the concentration was further diluted and used in the experiments.

Figure 96:
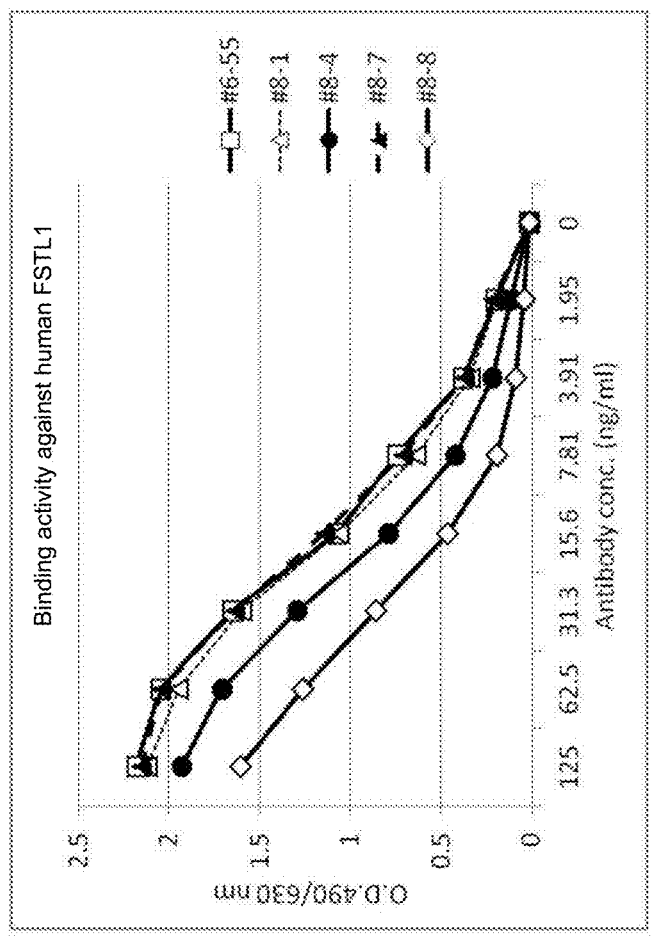

FIG. 96 shows results of evaluating the binding activity of clones obtained by middle screening against human FSTL1 by ELISA (Example 2). The open square depicts clone #6-55, the open triangle depicts clone #8-1, the filled circle depicts clone #8-4, the filled triangle depicts clone #8-7, and the open rhomboid depicts clone #8-8. The assay was conducted together with #6-55 for comparison. The strength of the binding activity was clone #6-55, #8-1, and #8-7>#8-4>#8-8. *The antibody concentration in FIG. 96 was diluted from 125 ng/ml.

Figure 97:
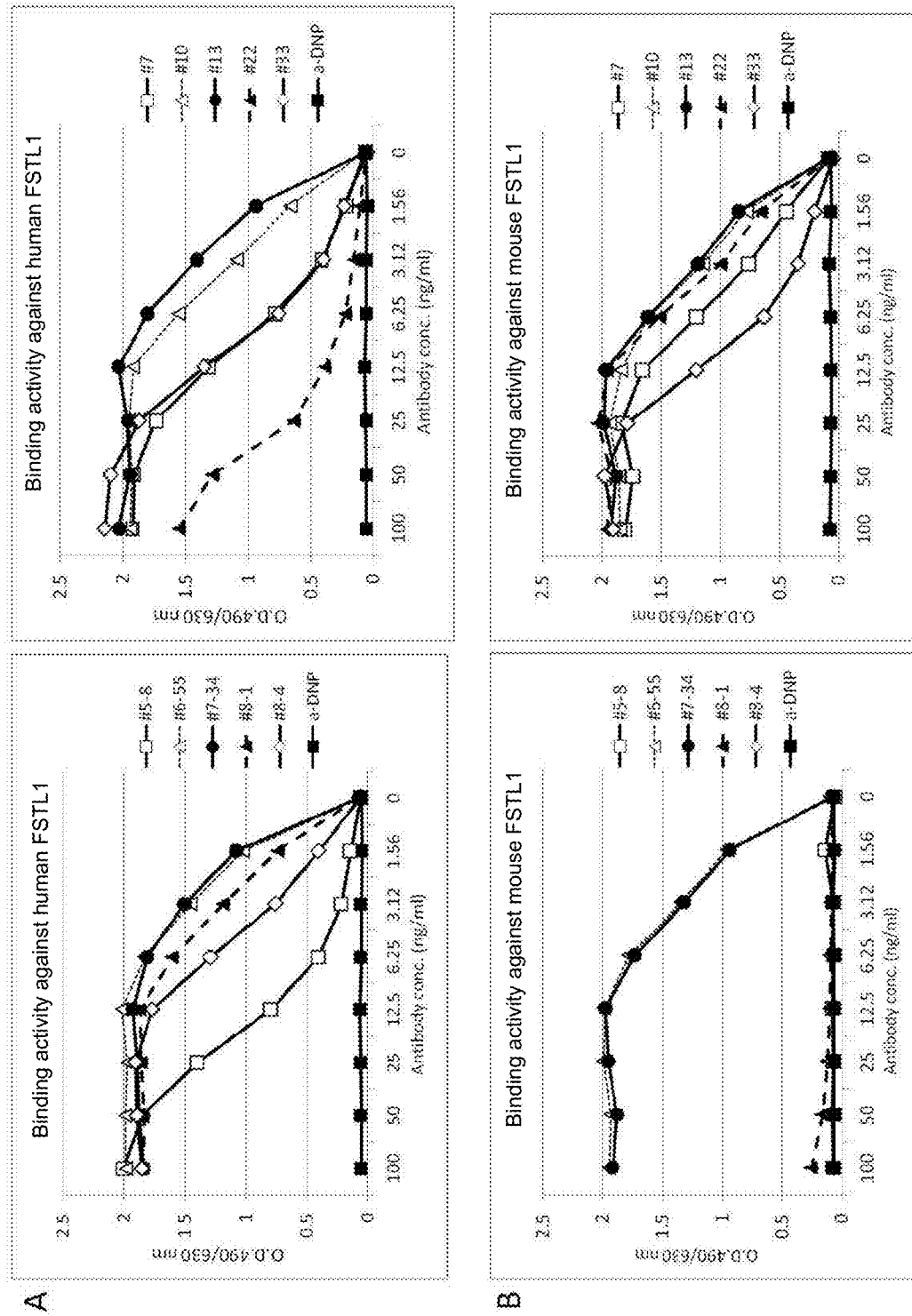

FIG. 97 is graphs showing the binding activity of clones obtained by panning using mouse FSTL1 (Example 2). The right and left graphs of Part A or the right and left graphs of Part B show results that were obtained by evaluation at the same time but were indicated by two divided graphs for the sake of the visibility of the figure due to a large number of clones. Part A shows results of evaluating the binding activity of clones also including clones (#7, #10, #13, #22, and #33) obtained by panning using mouse FSTL1 against human FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against human FSTL1 was #6-55, #7-34, and #13>#8-1 and #10>#8-4>#7 and #33>#5-8>#22. The binding activity of the anti-DNP antibody was not observed. Part B shows results of evaluating the binding activity of the same clones as above against mouse FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against mouse FSTL1 was #6-55, #7-34, #10, and #13>#22>#7>#33>#8-1. #8-1 slightly exhibited binding activity. #5-8, #8-4, and the anti-DNP antibody exhibited no binding activity. The antibody concentration in FIG. 97 was diluted from 100 ng/ml. On the basis of these ELISA results of binding activity and in vitro evaluation, promising clones to be subjected to in vivo evaluation were narrowed down (#6-55, #7-34, and #8-1). Clones newly obtained by panning (#7, #10, #13, #22, and #33) were further used as subjects in the in vivo evaluation.

Figure 98:
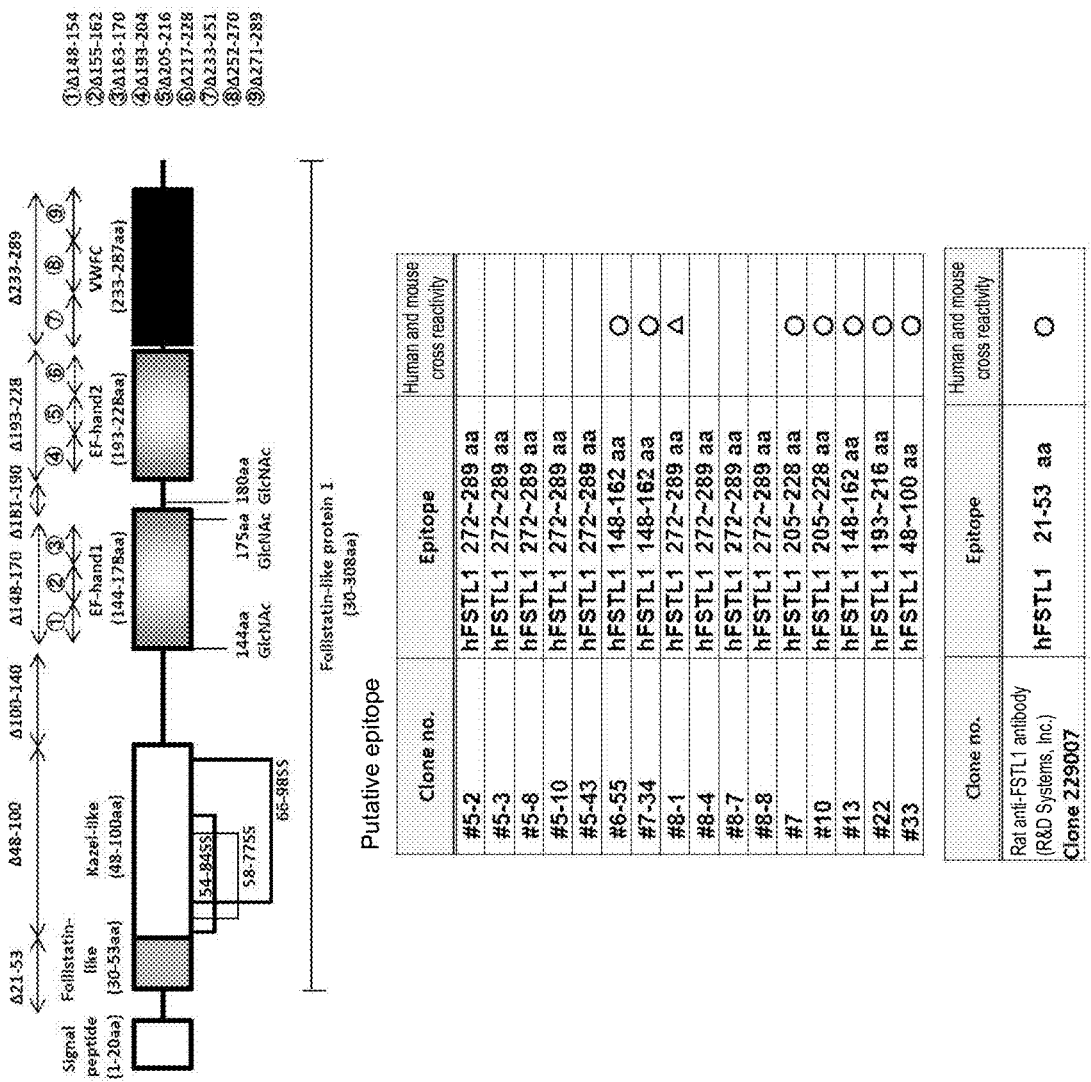

FIG. 98 shows deletion mutants and putative epitopes (Example 3). The upper diagram of FIG. 98 shows a schematic diagram of human FSTL1 and the positions of deletion sites. A putative epitope site for each clone was identified by ELISA using these deletion mutants of human FSTL1 as antigens. The lower diagram of FIG. 98 shows the comparison of putative epitopes between the obtained clones and a rat anti-FSTL1 antibody of R&D Systems, Inc. evaluated in Examples of Patent Literature 1 (WO2009/028411) in a table. Further, clones that exhibit the cross reactivity between humans and mice (strong binding activity: circle, weak binding activity: triangle) are described. As for criteria for strong or weak binding activity, binding activity found for both humans and mice at a concentration of 12.5 ng/ml was classified as "strong", and binding activity found for both humans and mice only at a higher concentration was classified as "weak".

Figure 99:
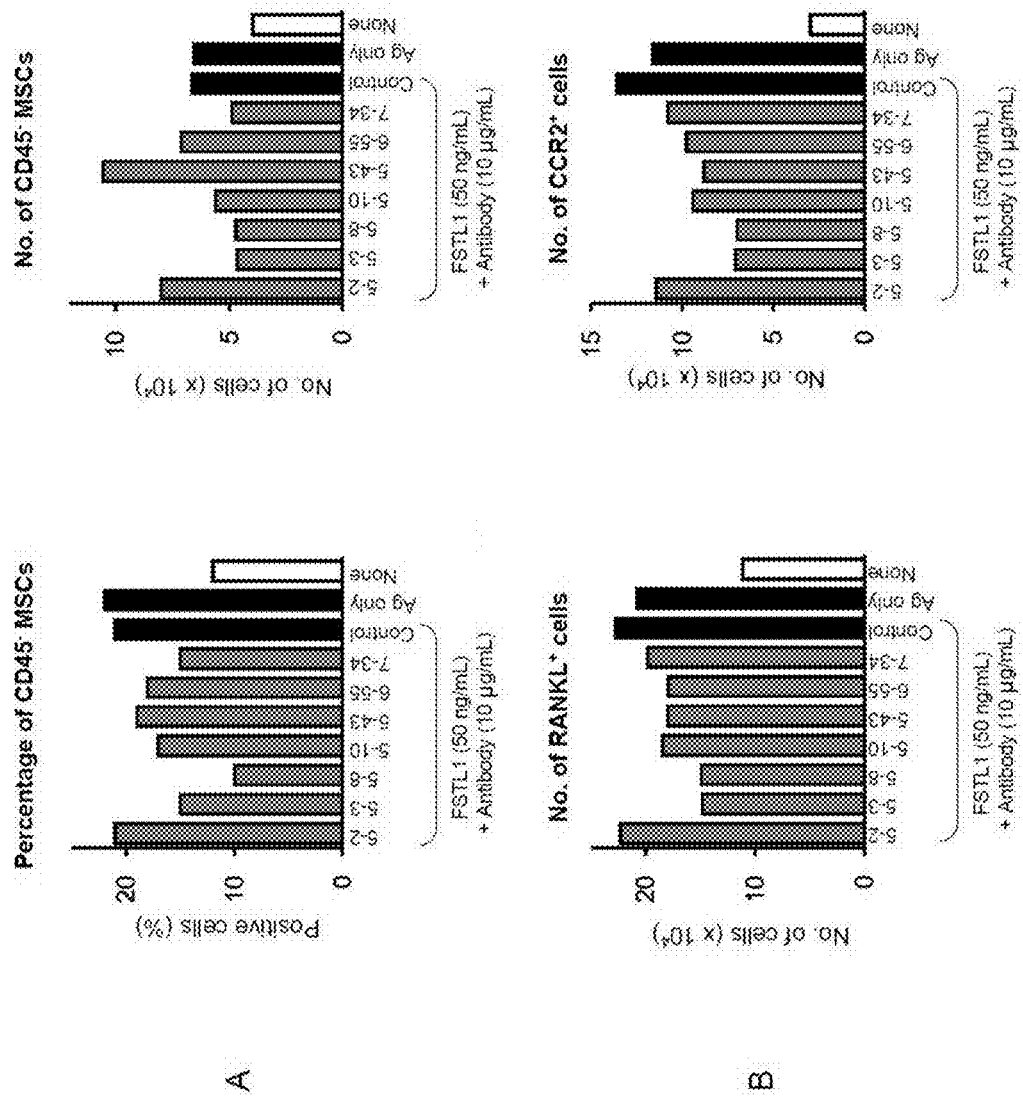

FIG. 99 shows results indicating effects brought about by the suppression of FSTL1 on mesenchymal stem cells (MSCs) and bone metastasis (Examples 6 and 7). Part A shows the influence of antibodies on an effect of inducing mouse bone marrow-derived mesenchymal stem cells by FSTL1 (Example 6). The proportion of mesenchymal stem cell (MSC) marker CD45-negative cells was analyzed by flow cytometry, and the percentage and number of the cells were shown. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity against the action of FSTL1, as compared with the control antibody (anti-DNP antibody). Among them, clone #5-3, #5-8, and #7-34 exhibited higher inhibitory activity and substantially completely inhibited the action of FSTL1. Part B shows the influence of antibodies on an effect of inducing RANKL- and CCR2-positive cells in a human pancreatic cancer cell line Panc1 by FSTL1 (Example 7). The expression of RANKL and CCR2 among molecules known as bone metastasis markers was analyzed by flow cytometry, and the numbers of positive cells were indicated in graphs. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity, as compared with the control antibody (anti-DNP antibody). Particularly, clone #5-3 and #5-8 exhibited higher inhibitory activity.

Figure 100A:
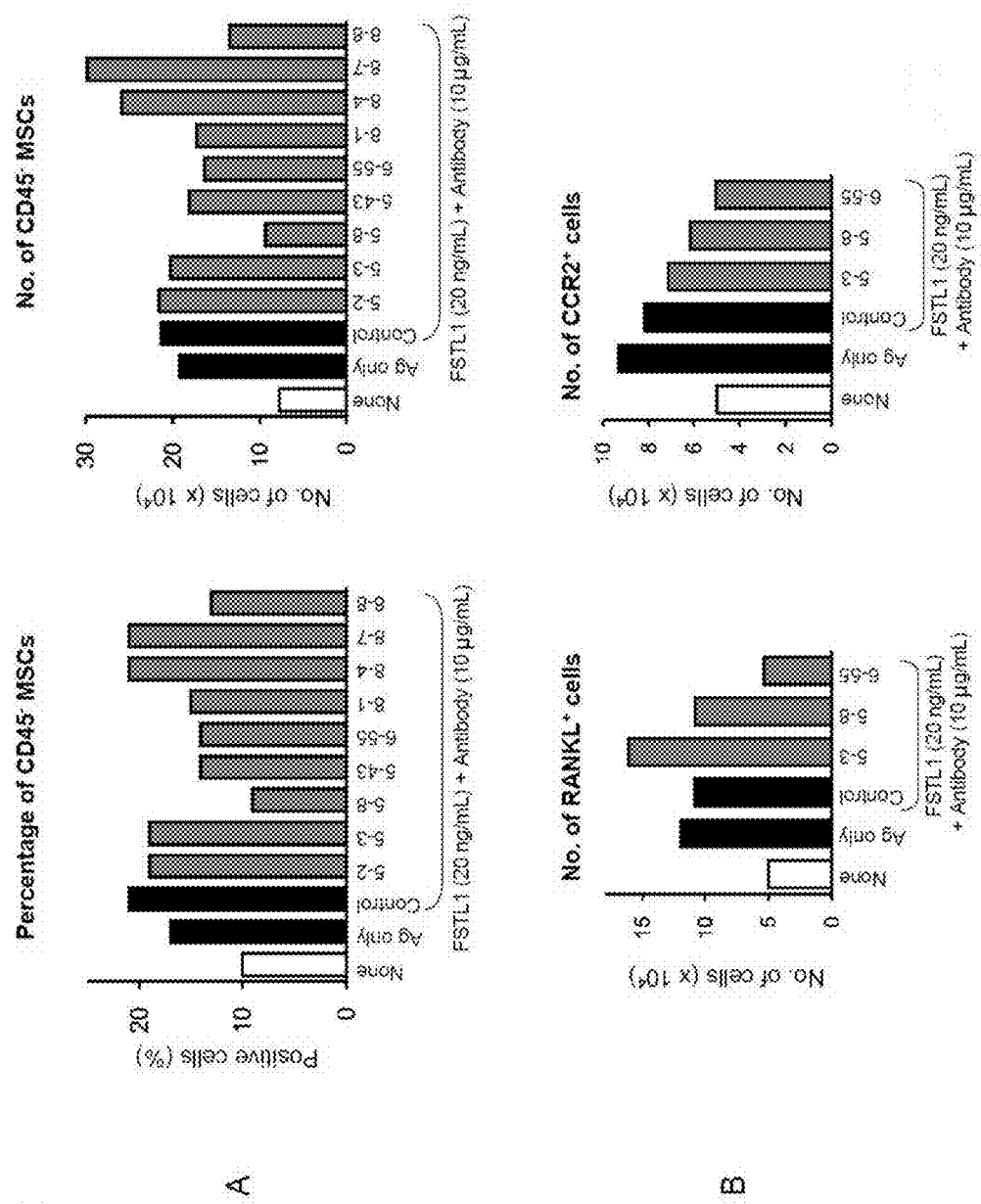

FIG. 100A also shows results indicating effects brought about by the suppression of FSTL1 on mesenchymal stem cells and bone metastasis (Examples 8 to 11). Part A shows the influence of antibodies on an effect of inducing mouse bone marrow-derived mesenchymal stem cells by FSTL1 (Example 8; the FSTL1 concentration was set to a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Inhibitory activity was confirmed in clone #5-8, #5-43, #6-55, #8-1, and #8-8. Part B shows the influence of antibodies on an effect of inducing RANKL- and CCR2-positive cells in a human pancreatic cancer cell line Panc1 by FSTL1 (Example 9; the FSTL1 concentration was set to a low concentration of 20 ng/ml). The expression of RANKL and CCR2 among molecules known as bone metastasis markers was analyzed by flow cytometry, and the numbers of positive cells were indicated in graphs. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Clone #5-8 and #6-55 exhibited higher inhibitory activity.

Figure 100B:
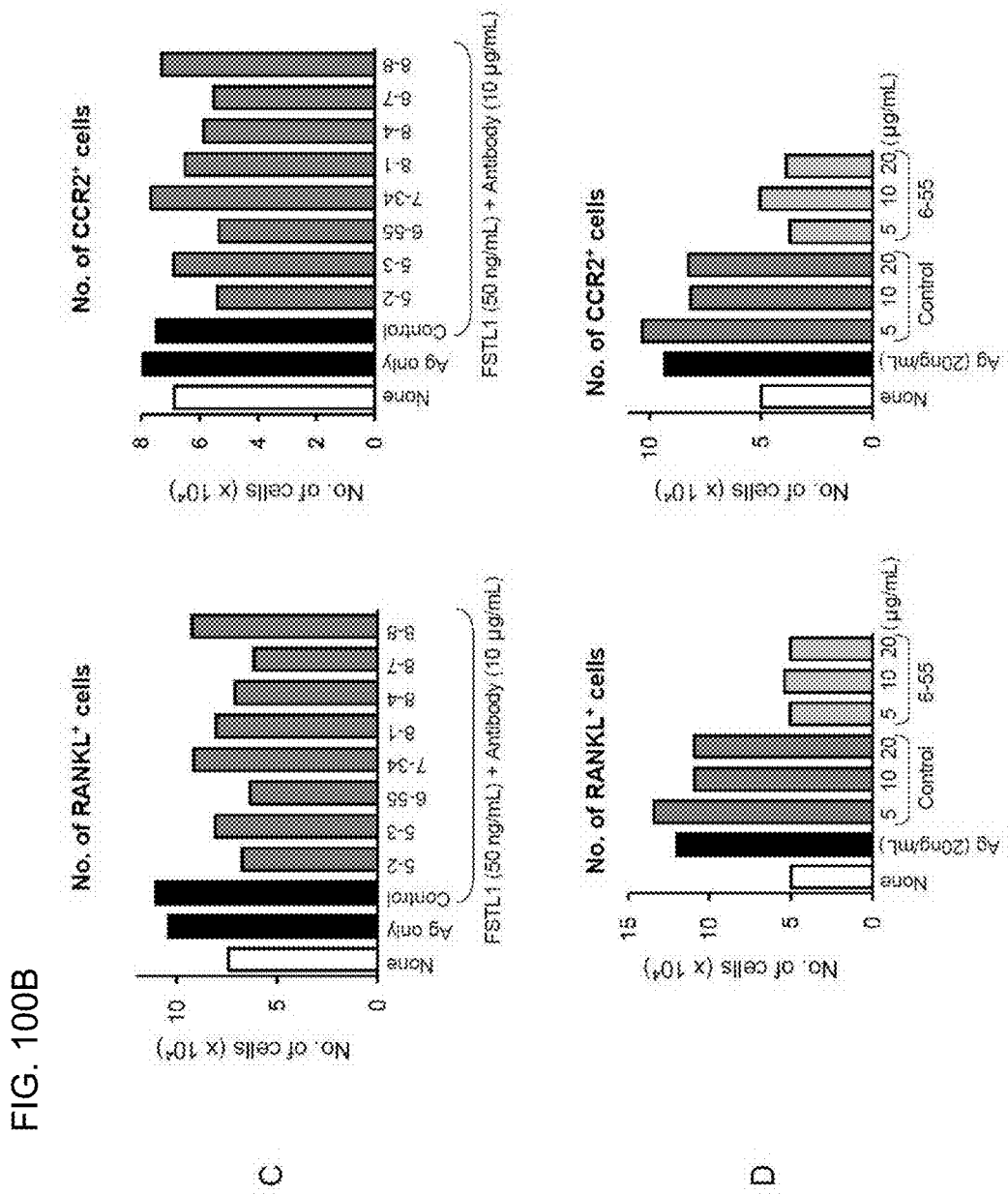

FIG. 100B Part C shows the influence of antibodies on an effect of inducing RANKL- and CCR2-positive cells in a human pancreatic cancer cell line Panc1 by FSTL1 (Example 10). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity, as compared with the control antibody (anti-DNP antibody). Particularly, clone #5-2, #6-55, #8-4, and #8-7 exhibited higher inhibitory activity. Part D shows the influence of an antibody on an effect of inducing RANKL- and CCR2-positive cells in a human pancreatic cancer cell line Panc1 by FSTL1. Here, an antibody dose dependence test was conducted (Example 11). The expression of RANKL and CCR2 among molecules known as bone metastasis markers was analyzed by flow cytometry, and the numbers of positive cells were indicated in graphs. Clone #6-55 exhibited inhibitory activity, as compared with the control antibody (anti-DNP antibody), though the dose dependence of the antibody was not confirmed. The clone shown in the graphs is depicted on the right bars, a control antibody (anti-DNP antibody) is depicted on the third bar from the left, an antigen alone is depicted on the second bar from the left, and a non-supplemented sample is depicted on the leftmost bar. Clone #6-55 strongly inhibited the cell induction of both RANKL-positive cells and CCR2-positive cells at the same time.

Figure 101:
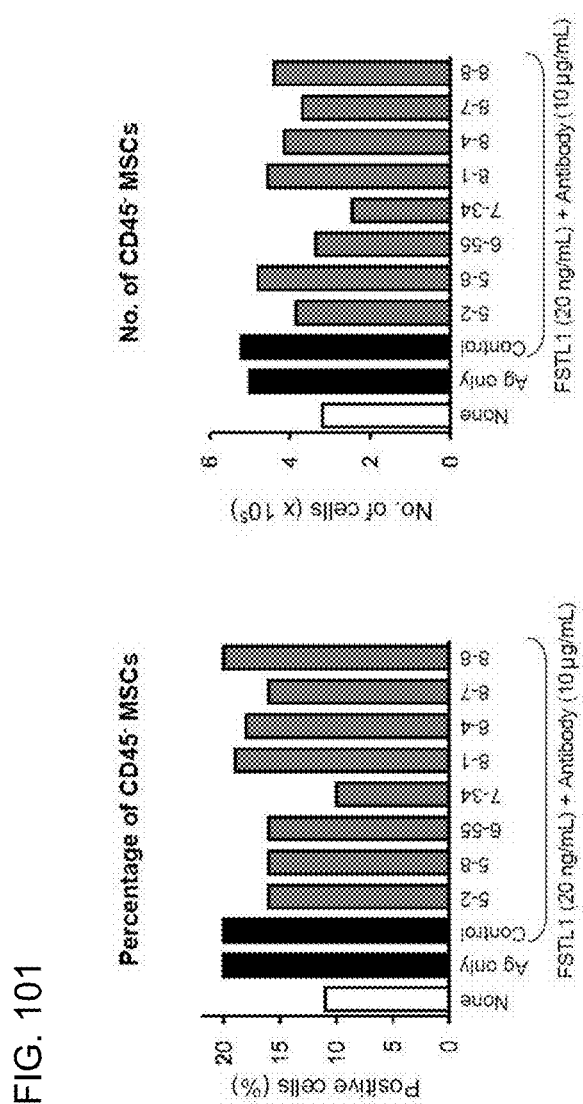

FIG. 101 shows the influence of antibodies on an effect of inducing mouse bone marrow-derived mesenchymal stem cells by FSTL1 (Example 12; the FSTL1 concentration used was a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity against the action of FSTL1, as compared with the control antibody (anti-DNP antibody). Particularly, stronger inhibitory activity was confirmed in the order of clone #7-34, #5-2, #6-55, and #8-7.

Figure 102:
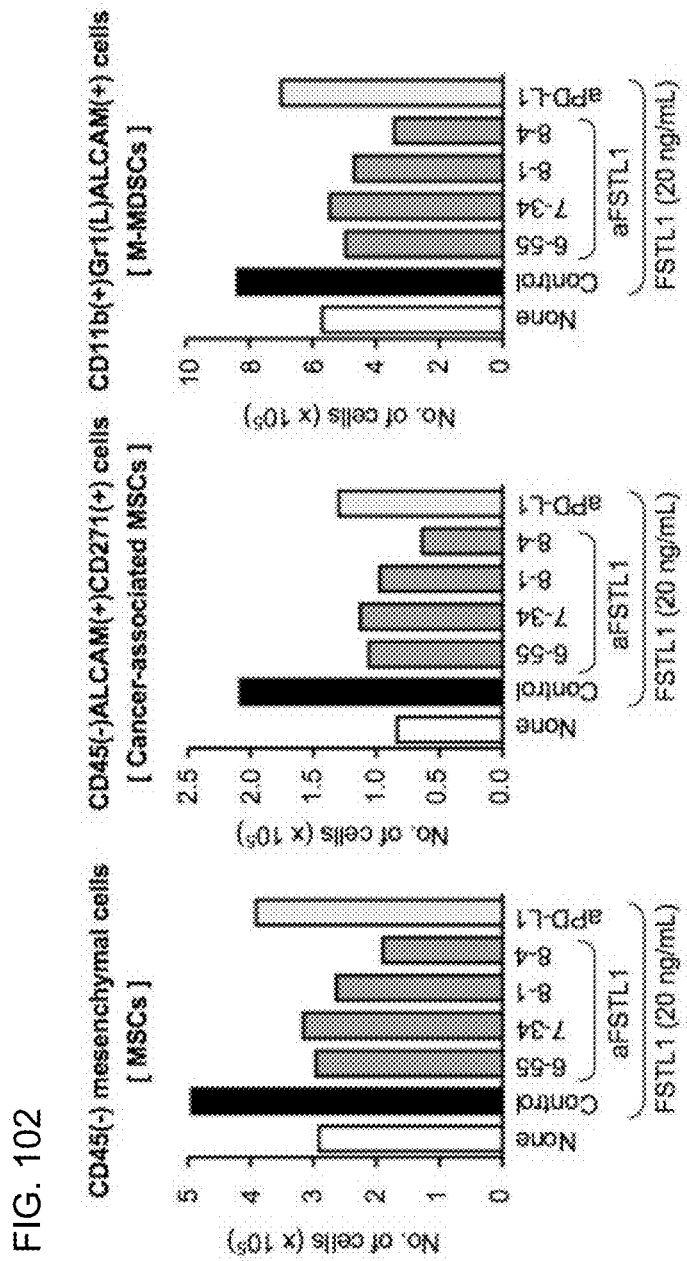

FIG. 102 shows results of evaluating the activity of anti-FSTL1 antibodies and an anti-PD-L1 antibody produced for in vivo (Example 13). Mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody is depicted in the second bar from the left, the anti-PD-L1 antibody is depicted in the rightmost bar, and intermediate 4 clones respectively represent the anti-FSTL1 antibodies. These antibodies produced for in vivo were found to be appropriate antibodies because all of the antibodies exhibited high inhibitory activity, as in the results mentioned above, as compared with the control antibody. PD-L1 is expressed in MSCs and presumably influences the induction of MSCs. However, inhibitory activity was found to be stronger in the anti-FSTL1 antibodies.

Figure 103:
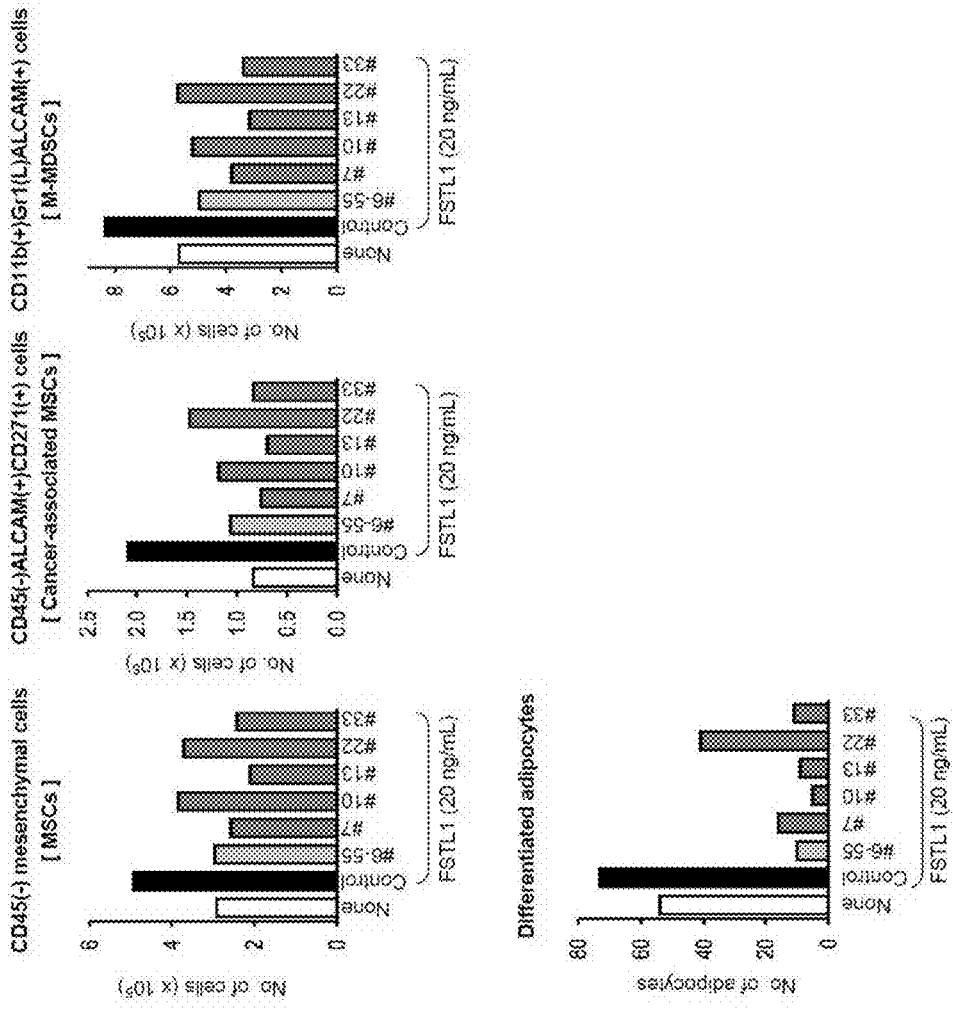

FIG. 103 Part A shows results of conducting the same test as that of FIG. 102 using other clones (clones described in each graph) (Example 14). As in FIG. 102, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody (anti-DNP antibody) is depicted shown in the second bar from the left, the anti-PD-L1 antibody is depicted in the rightmost bar, and intermediate 4 clones respectively represent the anti-FSTL1 antibodies. As a result, all of the clones exhibited inhibitory activity against the induction of MSCs, cancer-associated MSCs, and MDSCs by FSTL1, as compared with the control antibody. Among them, #13 and #33 exhibited inhibitory activity equivalent to or higher than that of the positive control (#6-55). These results seem to be reasonable because epitopes for #13 and #6-55 are the same regions. Part B shows results of analyzing inhibitory activity against the induction of MSCs having the ability to differentiate into adipocytes. In the graph, none is depicted in the leftmost bar, and a control is depicted in the second bar from the left followed by anti-FSTL1 antibody clones. All of the anti-FSTL1 antibody clones exhibited inhibitory activity against the differentiation induction of MSCs having the ability to differentiate into adipocytes by FSTL1.

Figure 104:
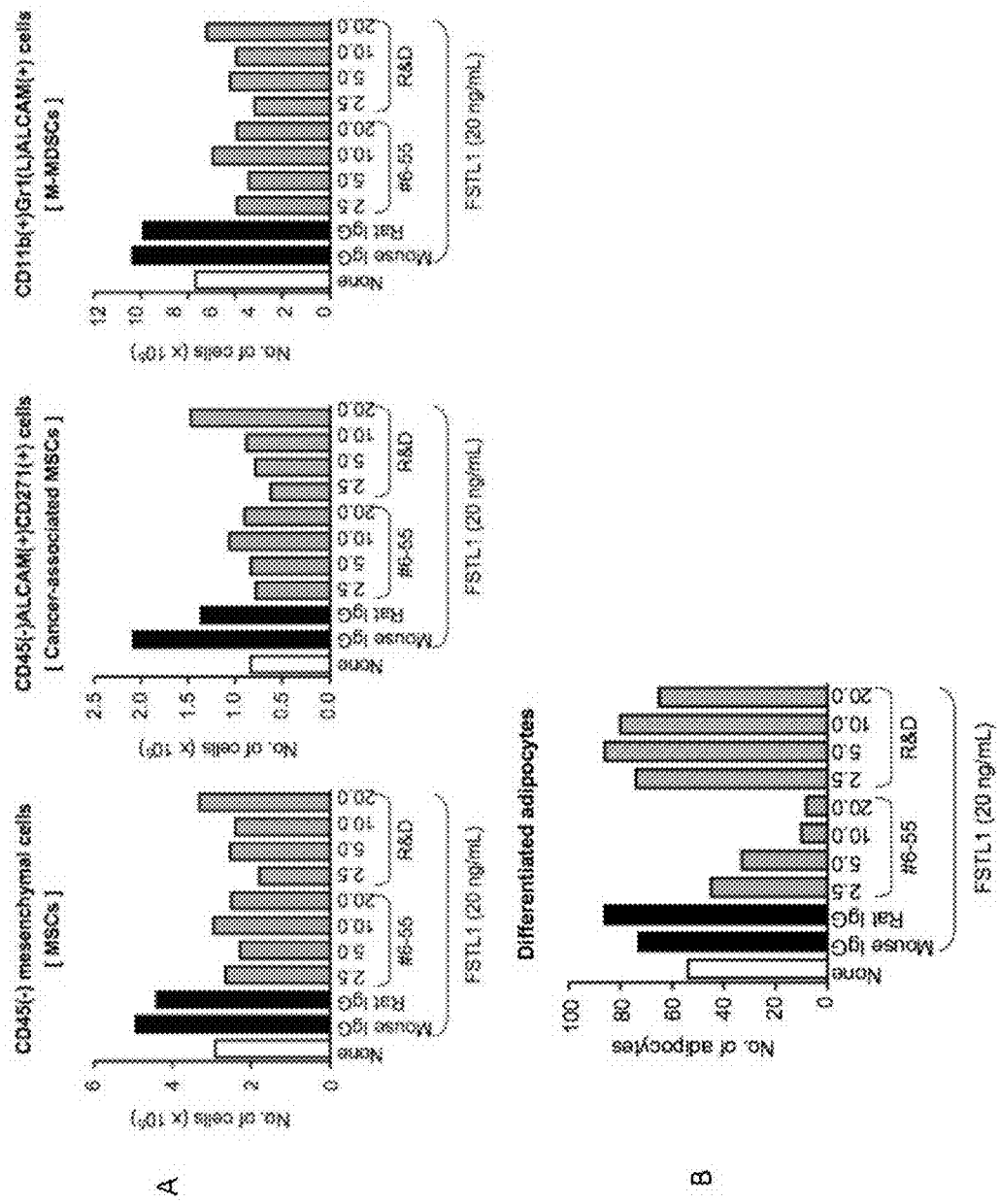

FIG. 104 shows activity comparison with an anti-FSTL1 antibody manufactured by R&D Systems, Inc. evaluated in Examples of Patent Literature 1 (WO2009/028411) (Examples 15 and 16). Part A shows results of conducting a dose dependence test in order to compare #6-55 (mouse chimeric antibody) with the anti-FSTL1 antibody manufactured by R&D Systems, Inc. (rat antibody; indicated by R&D), and analyzing inhibitory activity against the action of FSTL1 in the same way as in FIG. 102 (Example 15). In Part A, as in FIG. 102, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The antibody manufactured by R&D Systems, Inc. exhibited inhibitory activity against the induction of each cell by FSTL1 at the same level as in #6-55. No dose-dependent effect was confirmed. When the antibody of each isotype is used as a reference, the inhibitory activity of #6-55 is considered to be slightly superior. Part B shows results of analyzing inhibitory activity against the induction of MSCs having the ability to differentiate into adipocytes (Example 16). In the graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The induction of MSCs having the ability to differentiate into adipocytes was inhibited by #6-55 in an antibody dose-dependent manner. On the other hand, the antibody manufactured by R&D Systems, Inc. exhibited no inhibitory activity, demonstrating the superiority of the antibody of #6-55. The ability to differentiate into adipocytes is one of the functions of cancer-associated MSCs (cells also shown in the middle graph of Part A) inducing immunosuppression. From the comparison of Part A with Part B, it can be concluded that: when the rat control antibody, i.e., a "rat-derived protein", was administered into the living bodies of mice, its own response was reduced, as compared with the case of administering the mouse control antibody (mouse-derived protein) (particularly, the middle graph of Part A). This is presumably because immune response to foreign matter occurred slightly because mouse bone marrow cells were used. In the case of administering the FSTL1 antibody of R&D Systems, Inc., which is also a "rat-derived protein", comparison with this rat control antibody administration group was supposed to be reasonable. Nonetheless, in light of the "rate of suppression" with respect to each control protein, the rate of suppression of the FSTL1 antibody of R&D Systems, Inc. with respect to the rat control antibody administration group was smaller than the rate of suppression of 6-55 with respect to the mouse control antibody administration group, suggesting that #6-55 is superior as a matter of fact. Not all of CD45-negative MSCs induced by FSTL1 are cancer-associated MSCs which cause immunosuppression, and such cancer-associated MSCs need to be identified using several types of markers, the ability to differentiate into adipocytes, etc. It can be concluded that the antibody of the present invention can strongly inhibit the induction of cancer-associated MSCs by inhibiting the action of FSTL1.

Figure 105A:
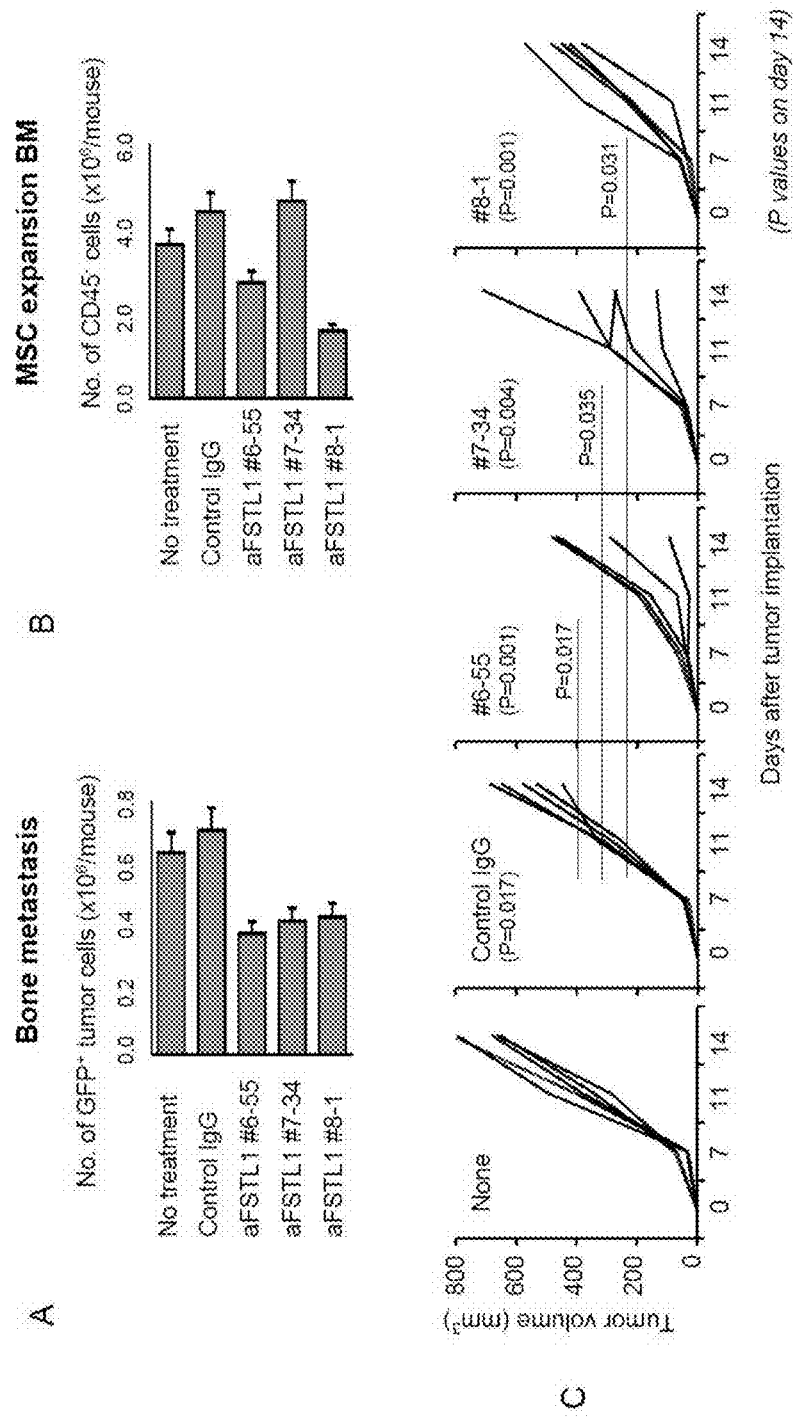

FIG. 105A shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 μg/0.1 mL/tumor). On day 14, various assays were conducted. Part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). Part B (the number of CD45-negative cells in bone marrow) shows results of analyzing the percentage (%) of CD45-negative cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). In both bar graphs, groups respectively receiving no treatment, a control antibody, clone #6-55, #7-34, and #8-1 are depicted from the upper to lower bars. Part C (tumor volume of each mouse individual) shows the tumor volume of each mouse individual (one line represents one mouse) measured 7, 11, and 14 days after tumor implantation, and shows the effects of various antibodies on tumor growth (subcutaneously transplanted tumor growth was suppressed). Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34.

Figure 105B:
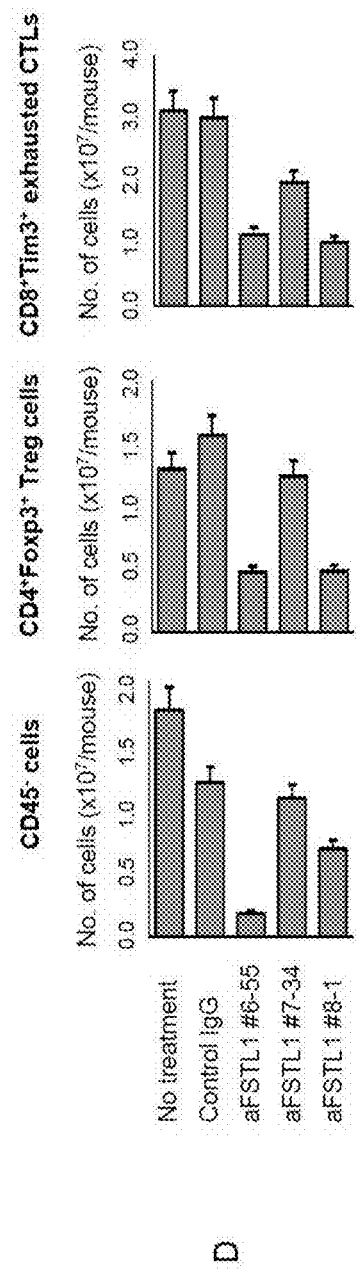

FIG. 105B shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 μg/0.1 mL/tumor). On day 14, various assays were conducted. Part D shows change in cell populations in the spleen. As presented, even if an antibody is administered locally, for example, into tumor, the whole body receives modification or influence. The left graph shows the number of CD45-negative cells and shows that MSCs also decrease in number in the spleen. The middle graph shows the number of CD4-positive and Foxp3-positive T cells and shows that Tregs decrease in number. The right graph shows the number of CD8-positive and Tim3-positive T cells and shows that exhausted CD8-positive T cells decrease in number. In this context, the exhaustion refers to a state having functional decline or dysfunction. Tim3 is a marker that reflects the state. If CD8-positive T cells supposed to kill tumor cells fall into an exhausted state, cancer cells cannot be eliminated from the living body.

Figure 106A:
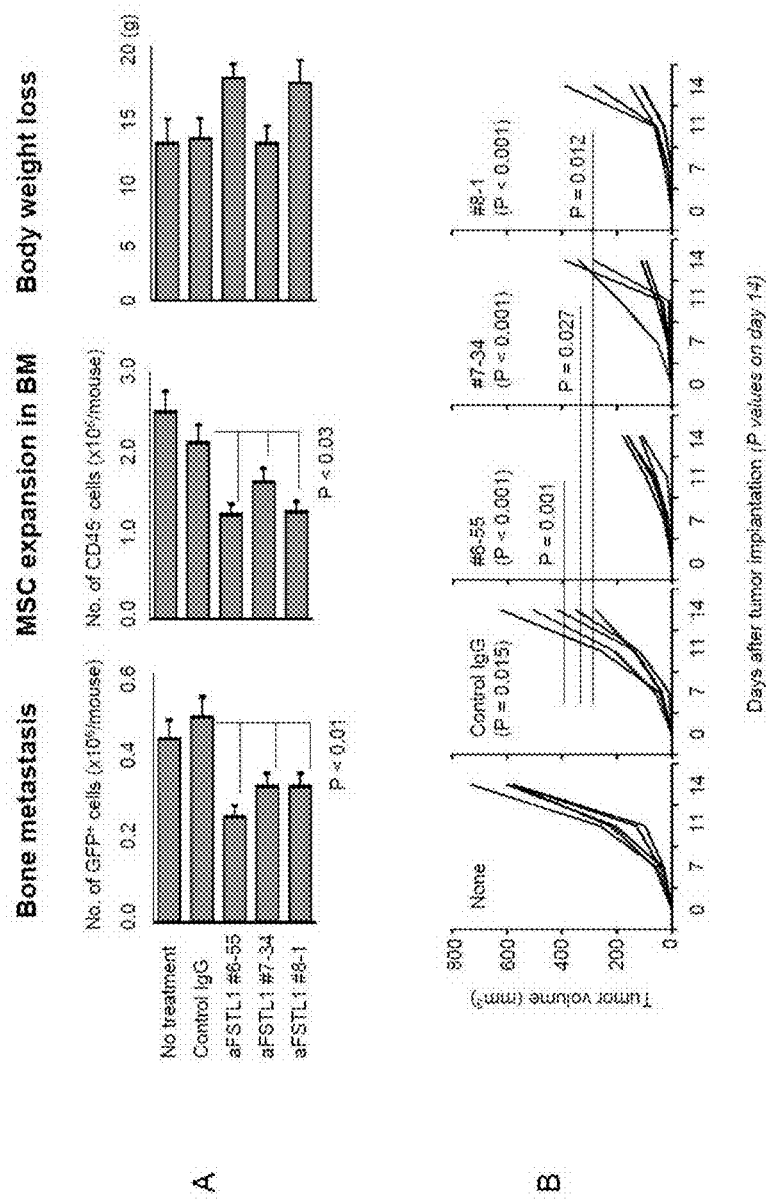

FIG. 106A also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5 \times 10^5$ cells subcutaneously & $1 \times 10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. The left graph of Part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). The middle graph of Part A (the number of CD45-negative cells in bone marrow) shows results of analyzing the percentage (%) of CD45− cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). The right graph of Part A (mouse body weight) shows effects on weight change (although a mouse is emaciated by bone metastasis, this was found to be suppressed as a result of measuring the body weight as an index thereof). In the bar graphs of Part A, groups respectively receiving no treatment, a control antibody, clone #6-55, #7-34, and #8-1 are depicted from the upper to lower bars. Five graphs of Part B show the tumor volume of each mouse individual (one line represents one mouse) measured 7, 11, and 14 days after tumor implantation, and show the effects of various antibodies on tumor growth. Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies to be tested significantly suppressed the growth of subcutaneous tumor with respect to the control antibody. In addition, an anti-weight loss effect was confirmed by the administration of #6-55 and #8-1.

Figure 106B:
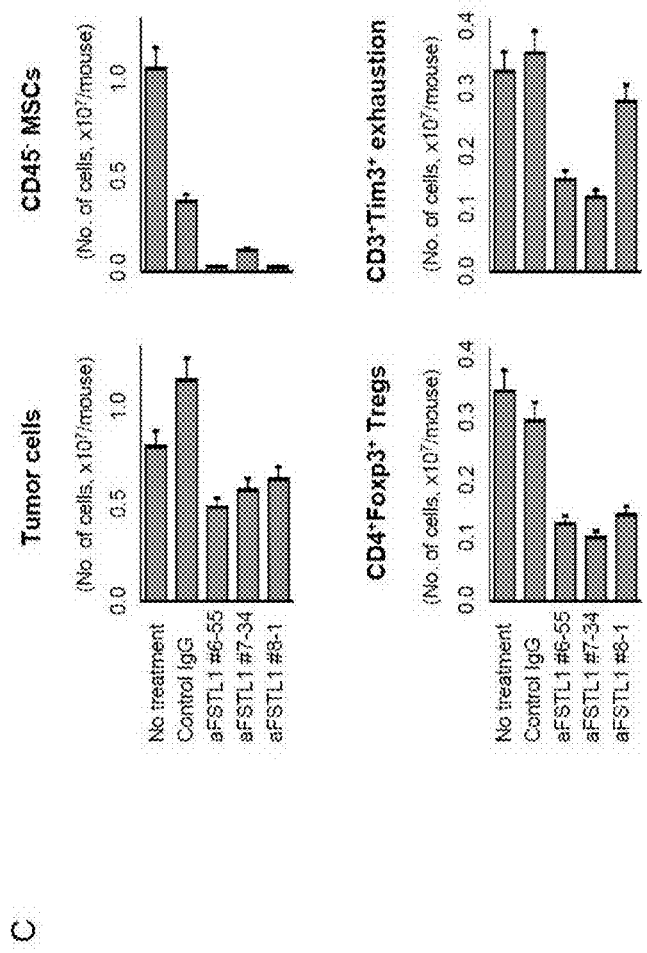

FIG. 106B also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5\times 10^5$ cells subcutaneously & $1\times 10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. Part C shows change in cell populations in the spleen. The upper left graph of Part C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Figure 107:
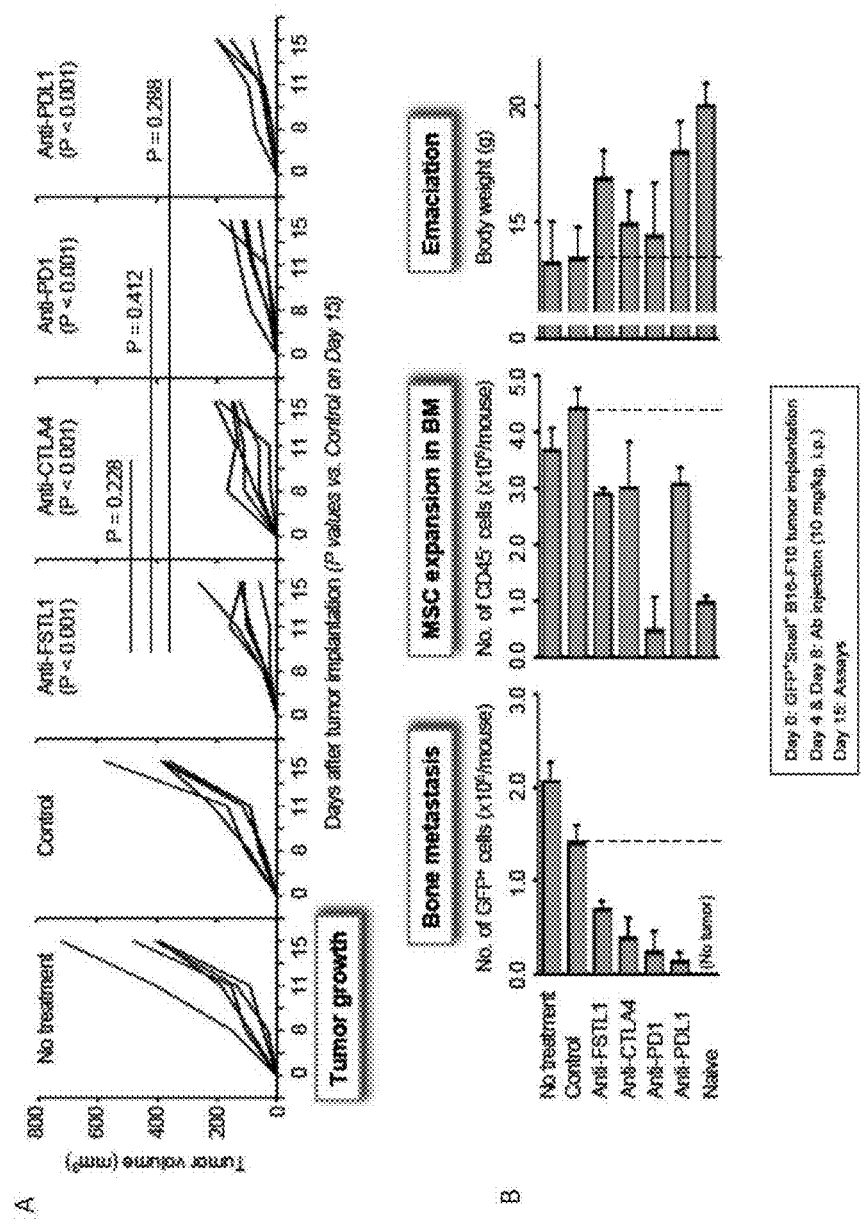

FIG. 107 also shows results of evaluating antibody activity in vivo (Example 19). This figure shows results of comparing drug efficacy between existing antibody drugs for mitigation of immunosuppression and an anti-FSTL1 antibody using bone metastasis models having a transplant of mouse melanoma B16-F10 cells forced to express Snail. Part A shows the effects of various antibodies on tumor volume over time. This figure shows the tumor volume of each mouse individual (one line represents one mouse) measured 8, 11, and 15 days after tumor implantation, and shows the effects of various antibodies on tumor growth. No treatment, a control antibody, an anti-FSTL1 antibody, an anti-CTLA4 antibody, an anti-PD-1 antibody, and an anti-PD-L1 antibody are depicted from the left to the right. The numerical values within the parentheses and the numerical values on the lines (indicated by P) represent p values regarding statistical significance (day 15). The abscissa shows the number of days. The ordinate shows tumor volume ($mm^3$). On day 0, GFP-positive and Snail-positive B16-F10 tumor cells were transplanted ($5\times 10^5$ cells subcutaneously & $1\times 10^5$ cells intravenously). On day 4, the antibody was intraperitoneally administered (first dose, corresponding to 200 µg/mouse=10 mg/kg). On day 8, the antibody was intraperitoneally administered (second dose, corresponding to 200 µg/mouse=10 mg/kg). On day 15, various assays were conducted. The left graph of Part B shows effects on bone metastasis (the number of GFP-positive cells ($10^6$/mouse)). The middle graph of Part B shows effects on MSC expansion in bone marrow (the number of CD45-negative cells (($10^6$/mouse)). The right graph of Part B shows effects on weight change (body weight (g)). All of the graphs of Part B depict no treatment, a control antibody, an anti-FSTL1 antibody, an anti-CTLA4 antibody, an anti-PD-1 antibody, and an anti-PD-L1 antibody from the upper to lower bars. The following existing antibody drugs were used as control antibodies: Anti-CTLA4 mAb (clone 9H10, BioLegend, Inc.); Anti-PD-1 mAb (clone 29F.1A12, BioLegend, Inc.); and Anti-PD-L1 mAb (clone 10F.9G2, BioLegend, Inc.). In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Figure 108B:
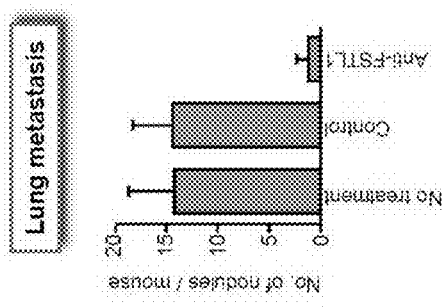
Figure 108A:
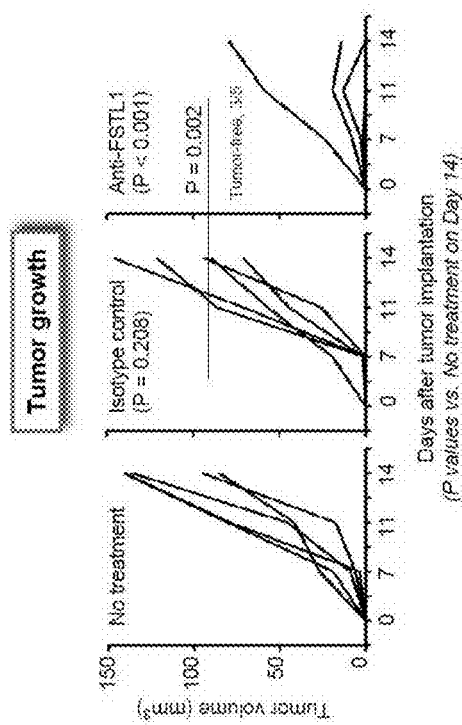

FIG. 108A also shows results of evaluating antibody activity in vivo (Example 20). This figure shows results of evaluating the drug efficacy of an anti-FSTL1 antibody using mouse colorectal cancer CT26 cell-transplanted models. All of the 3 graphs of FIG. 108A show effects on tumor growth. This figure shows the tumor volume of each mouse individual (one line represents one mouse) measured 7, 11, and 14 days after tumor implantation, and shows the effects of various antibodies on tumor growth. The left graph depicts no treatment, the middle graph depicts a control antibody (anti-DNP antibody), and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm$^3$). Drug efficacy evaluation was conducted using mouse tumor models other than Snail+ tumor bone metastasis models. In this Example, the drug efficacy of the anti-FSTL1 antibody was evaluated using cancer-bearing models of BALB/c mice different in strain from the C57BL/6 mice used in the preceding tests.

FIG. 108B shows results about the number of metastatic nodules in the lung. The left bar depicts no treatment, the middle bar depicts a control antibody (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to "lung" is inhibited. Therefore, it is understood that the antibody of the present invention is effective against general cancer metastasis.

Figure 109:
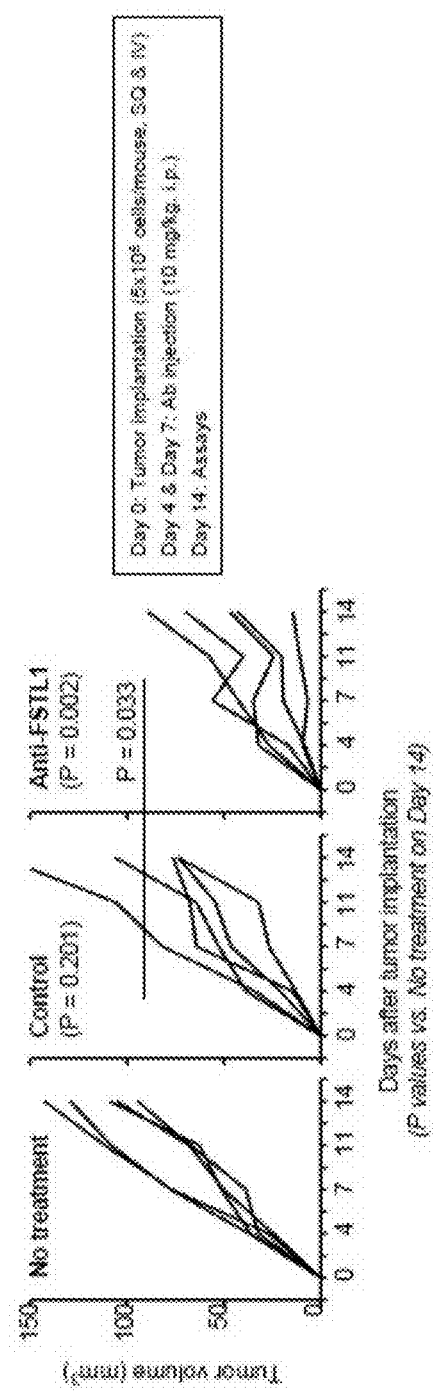

FIG. 109 also shows results of evaluating antibody activity in vivo (Example 21). This figure shows results of evaluating the drug efficacy of an anti-FSTL1 antibody using mouse breast cancer 4T1 cell-transplanted models. All of the 3 graphs show effects on tumor growth. This figure shows the tumor volume of each mouse individual (one line represents one mouse) measured 4, 7, 11, and 14 days after tumor implantation, and shows the effects of various antibodies on tumor growth. The left graph depicts no treatment, the middle graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm$^3$). On day 0, tumor cells were transplanted (5×10$^5$ cells subcutaneously & 5×10$^5$ cells intravenously). On days 4 and 7, the antibody was intraperitoneally administered (10 mg/kg). On day 14, drug efficacy evaluation (subcutaneous tumor growth) was conducted. The drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The growth of 4T1 subcutaneous tumor was able to be significantly suppressed by the administration of the anti-FSTL1 antibody (#6-55).

Figure 110:
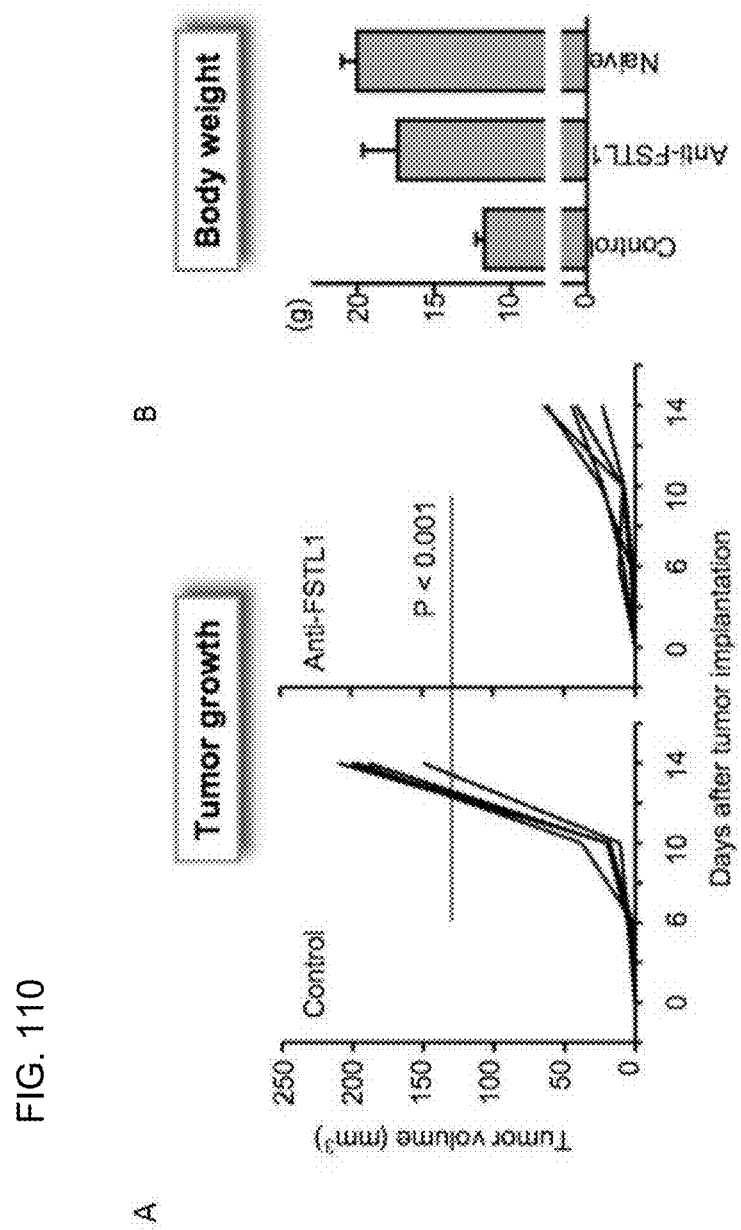

FIG. 110 Part A also shows results of evaluating antibody activity in vivo (Example 22). This figure shows results of evaluating the drug efficacy of an anti-FSTL1 antibody using mouse melanoma B16-F10. Both two graphs of the left panel show effects on tumor growth. This figure shows the tumor volume of each mouse individual (one line represents one mouse) measured 6, 10, and 14 days after tumor implantation, and shows the effects of various antibodies on tumor growth. The left graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm$^3$). Part B shows effects on weight change. The left bar depicts a control antibody, the middle bar depicts the anti-FSTL1 antibody, and the right bar depicts an untreated individual that received no tumor cell. The ordinate shows tumor volume (g). The drug efficacy of the anti-FSTL1 antibody was evaluated using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests. Subcutaneous tumor growth was strongly suppressed by the administration of the anti-FSTL1 antibody (#6-55), as compared with the control antibody administration group. Also, suppressive activity against weight loss was also exhibited.

Figure 111:
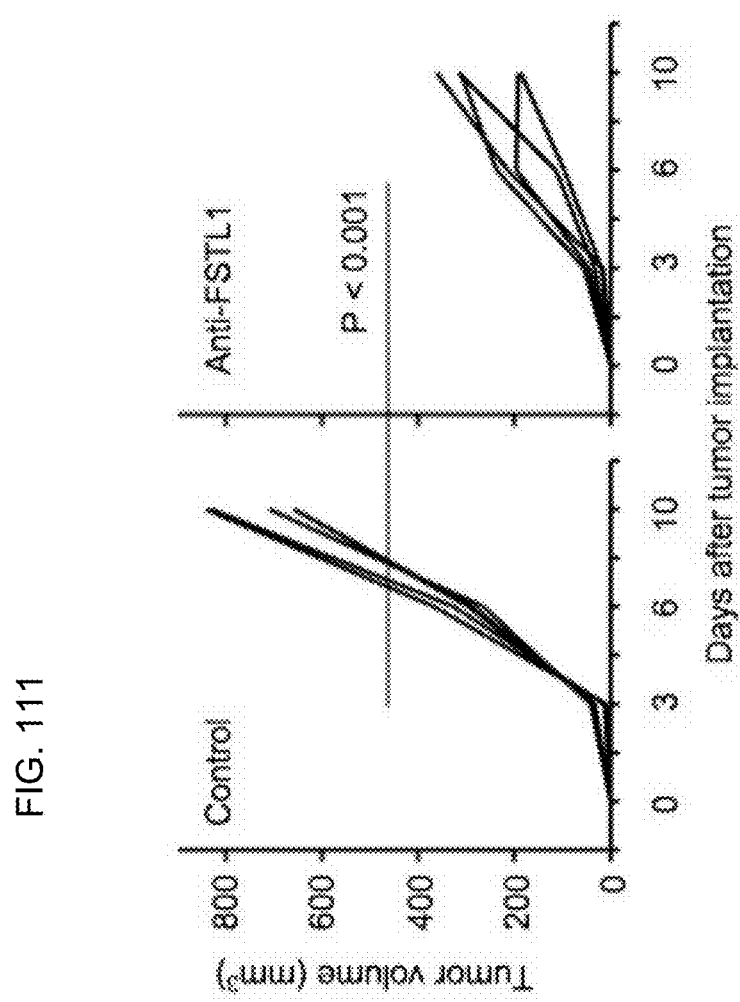

FIG. 111 also shows results of evaluating antibody activity in vivo (Example 23). This figure shows results of evaluating the drug efficacy of an anti-FSTL1 antibody using mouse lymphoma EL4. Both two graphs show effects on tumor growth. This figure shows the tumor volume of each mouse individual (one line represents one mouse) measured 3, 6, and 10 days after tumor implantation, and shows the effects of various antibodies on tumor growth. The left graph depicts a control antibody, and the right graph depicts the anti-FSTL1 antibody. The numerical values within the parentheses and the numerical values on the lines (indicated by P) represent p values regarding statistical significance (day 14). The abscissa shows the number of days. The ordinate shows tumor volume (mm$^3$). The drug efficacy of the anti-FSTL1 antibody was evaluated using mouse lymphoma EL4, which is a cancer type having enhanced FSTL1 expression. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group.

Figure 112:
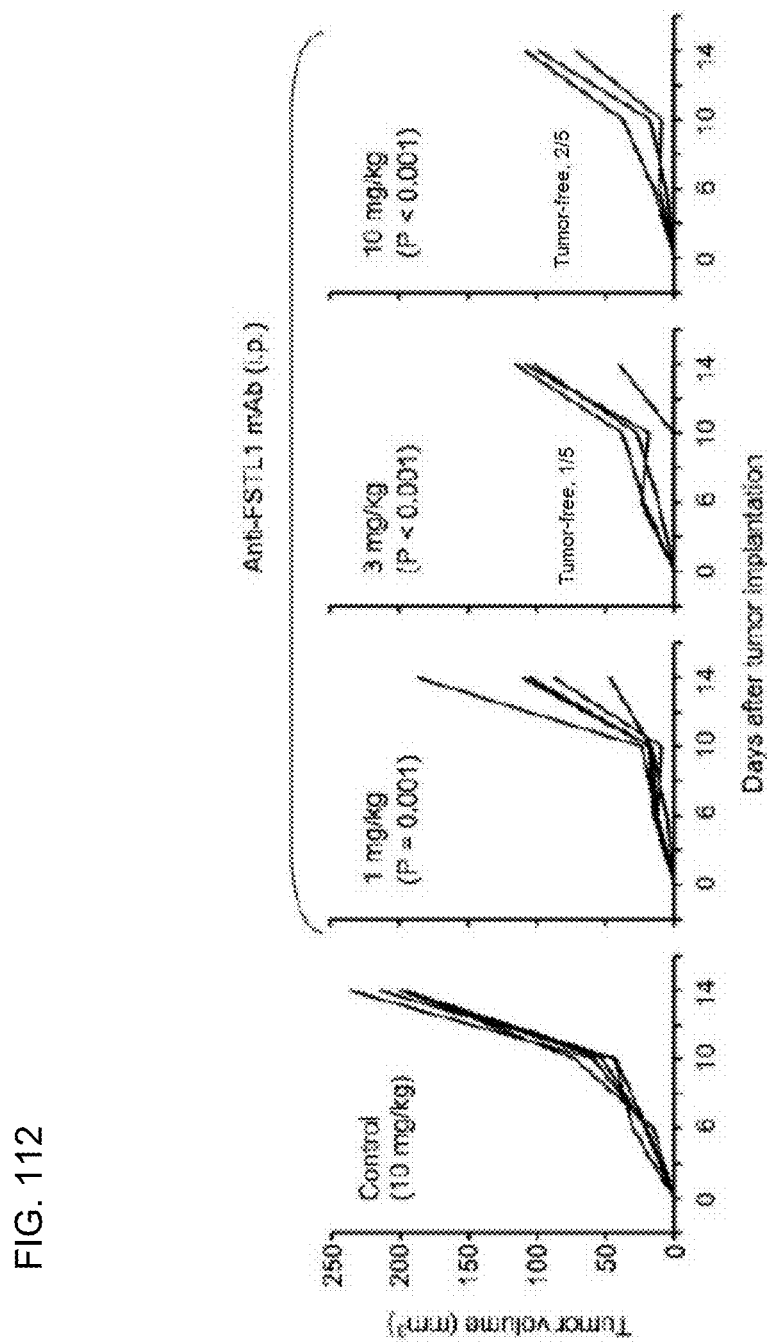

FIG. 112 also shows results of evaluating antibody activity in vivo (Example 24). This figure shows results of evaluating the drug efficacy of an anti-FSTL1 antibody using mouse melanoma B16-F10. All of the 4 graphs show effects on tumor growth. This figure shows the tumor volume of each mouse individual (one line represents one mouse) measured 6, 10, and 14 days after tumor implantation, and shows the effects of various antibodies on tumor growth. The leftmost graph depicts a control antibody, the second graph from the left depicts 1 mg/kg of the anti-FSTL1 antibody, the second graph from the right depicts 3 mg/kg of the anti-FSTL1 antibody, and the rightmost graph depicts 10 mg/kg of the anti-FSTL1 antibody. The numerical values within the parentheses and the numerical values on the lines (indicated by P) represent p values regarding statistical significance (day 14). The abscissa shows the number of days. The ordinate shows tumor volume (mm$^3$). The drug efficacy of the anti-FSTL1 antibody was evaluated in the same test system as in the experiment illustrated in FIG. 110 except that only subcutaneous transplantation was performed here in order to more clearly evaluate reactivity. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Figure 113:
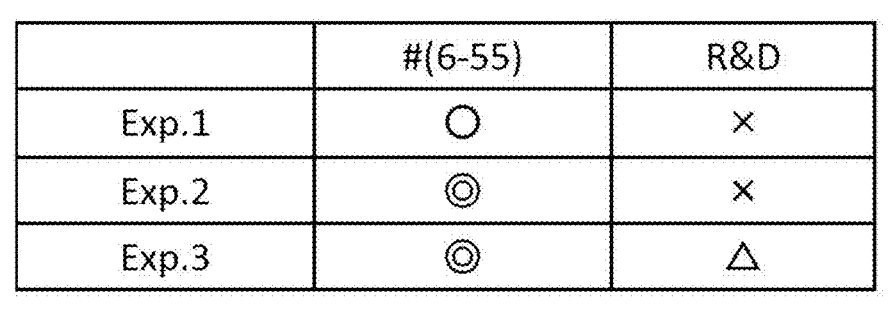

FIG. 113 shows results of a Treg induction experiment in which activity was measured with % CD4+ Foxp3+CTLA4+ cells as an index in an experimental system involving the anti-FSTL1 antibody (#6-55) of the present invention and a known anti-FSTL1 antibody (R&D Systems, Inc., Cat. No. MAB1694, clone 229007). The double circle, the circle, and the triangle depict statistical significance and represent 30% or more decrease, 10% to 30% decrease, and less than 10% decrease, respectively. The cross mark represents the absence of statistically significant difference.

Figure 114:
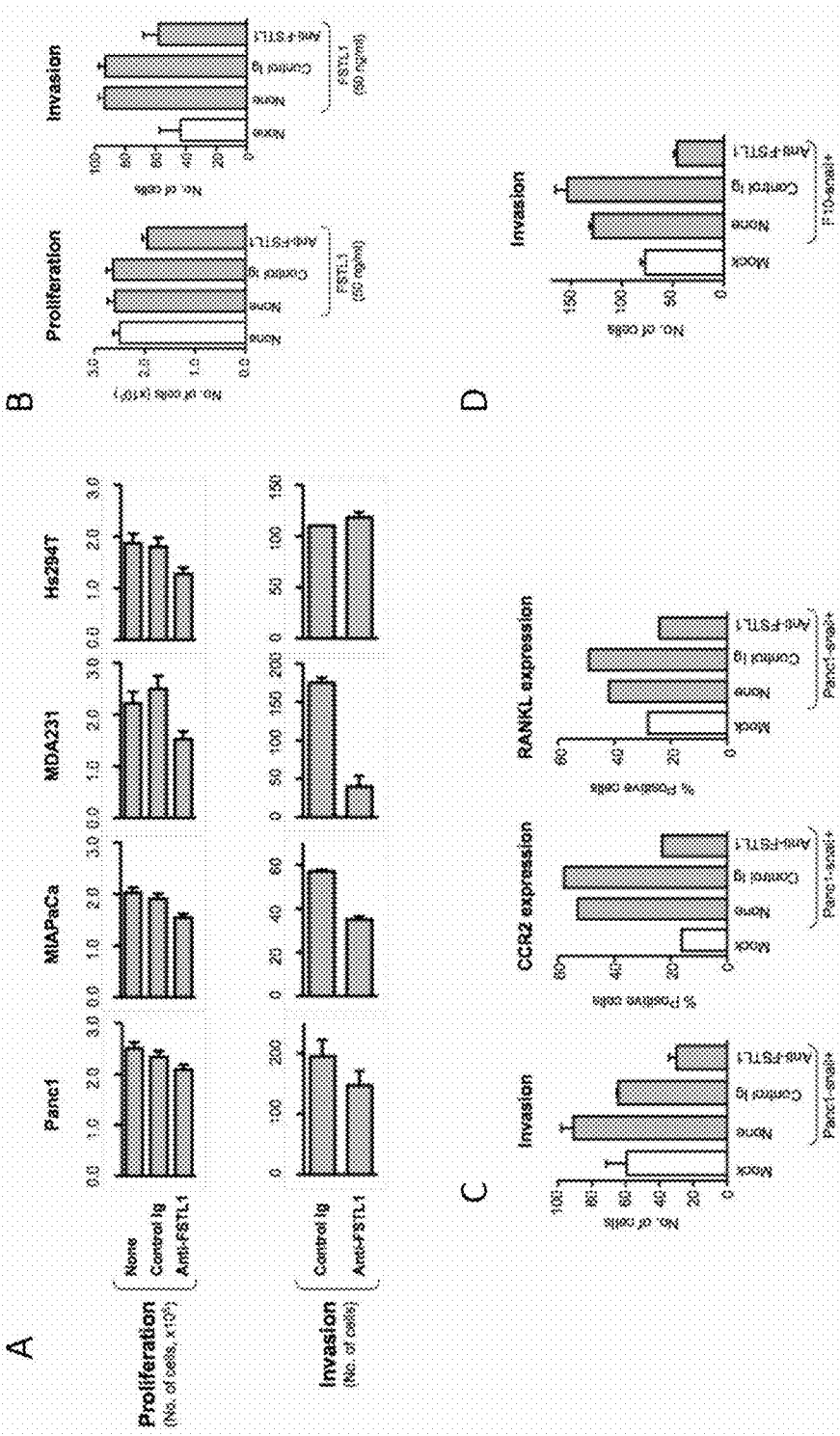

FIG. 114 shows results of examining various functions of an anti-FSTL1 antibody. Panel A shows the influence of the anti-FSTL1 antibody on the proliferative capacity and invasive capacity of various human tumor cells. The upper graphs of panel A show the results about proliferation, and the lower graphs show the results about invasion. Panc1, MIAPaCa, MDA231, and Hs294 are depicted from the left to the right. The upper graphs show the number of cells ($\times 10^3$) after culture for 3 days. The lower graphs show the number of tumor cells treated with the antibody for 3 days. In each of the upper graphs, none, control IgG, and the anti-FSTL1 antibody are depicted from the upper to lower bars. In each of the lower graphs, the upper bar depicts control IgG, and the lower bar depicts the anti-FSTL1 antibody. These results demonstrated that Snail+ tumor cells have very high metastatic properties. Panel B shows the action of the anti-FSTL1 antibody under FSTL1 stimulation. The left graph shows proliferative capacity, and the right graph shows invasive capacity. In both graphs, the left bar depicts none, and the second to fourth bars from the left depict none, mouse IgG, and the anti-FSTL1 antibody (#6-55) in order in the presence of FSTL1 (50 ng/ml). Panels C and D show the action of the anti-FSTL1 antibody on cells forced to express Snail. Panel C shows the results about Matrigel invasion, CCR2 expression, and RANKL expression from the left to the right. In all of the graphs, the left bar depicts Panc1 cells of a parent line that were not forced to express Snail (Mock), and the second bar from the left to the rightmost bar depict none, mouse IgG, and the anti-FSTL1 antibody (#6-55) in order in the presence of the anti-FSTL1 antibody (50 ng/ml). Panel D shows results obtained in Snail transfectants of mouse melanoma B16t-F10. In the graph, the left bar depicts a false antibody (Mock), and the second bar from the left to the rightmost bar depict none, mouse IgG, and the anti-FSTL1 antibody (#6-55) in order in the presence of FSTL1 (50 ng/ml).

Figure 115:
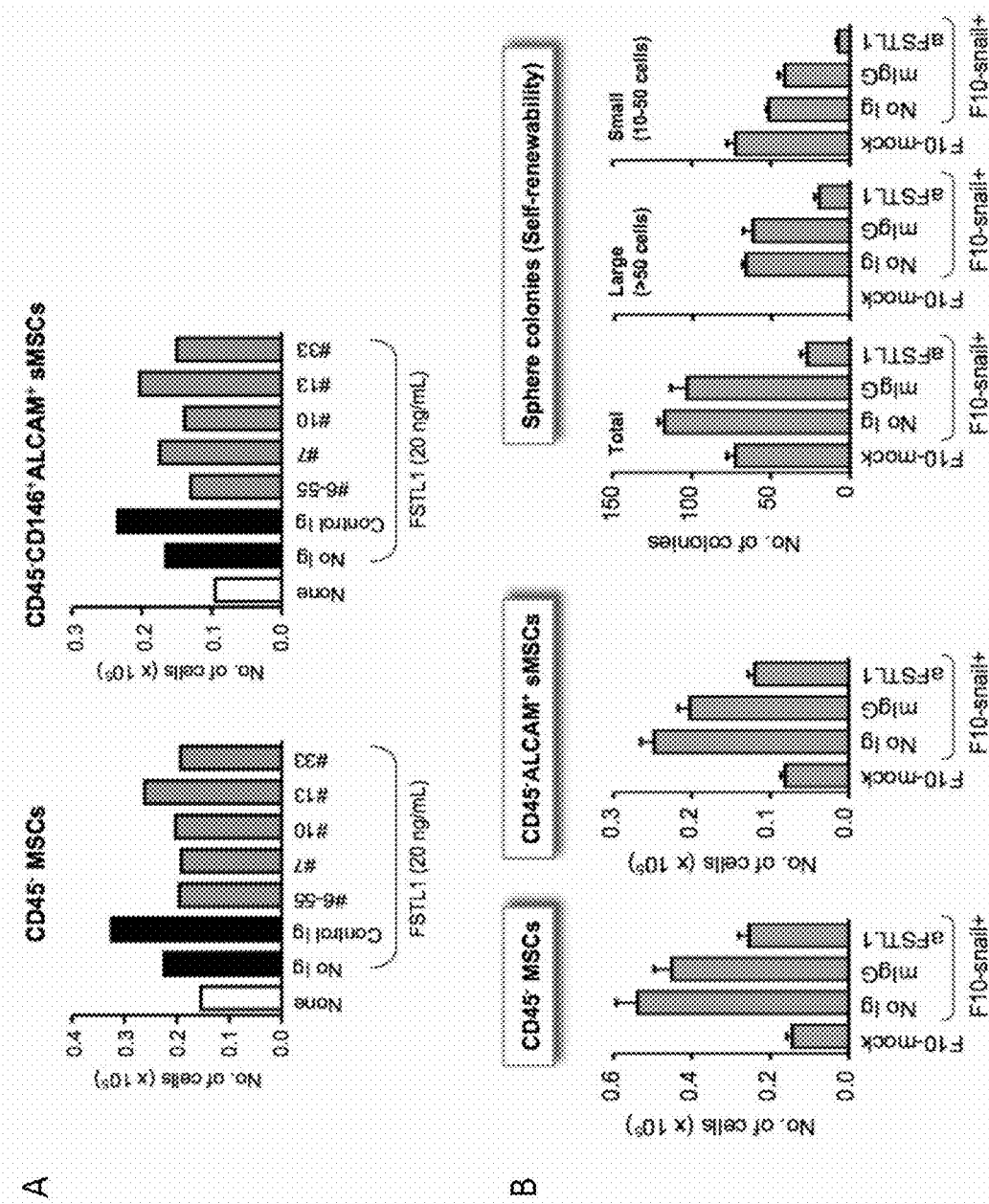

FIG. 115 shows results of a MSC induction inhibition test using mouse bone marrow cells. In panel A, the left graph depicts CD45+ MSC cells, and the right panel depicts CD45+CD146+ALCAM+ sMSCs. The left bar depicts none, and the second bar from the left to the rightmost bar show results obtained in FSTL1 (20 ng/ml) and depict no immunoglobulin, mouse immunoglobulin, and the antibody #6-55, #7, #10, #13, and #33 of the present invention in order. Panel B depicts CD45− MSC cells, CD45−ALCAM+ sMSC cells, and sphere colonies (self-renewability). The leftmost bar depicts F10-mock, and the second bar from the left to the rightmost bar depict F10-snail+. Results about no immunoglobulin, mouse immunoglobulin, and the anti-FSTL1 antibody are shown in order from the second bar from the left. The results are indicated by the number of cells in the left and middle graphs. The sphere colonies represent the number of colonies. Among the 3 graphs of the sphere colonies, the left graph shows the total number, the middle graph shows large colonies (>50 cells), and the right graph shows small colonies (10 to 50 cells).

Figure 116:
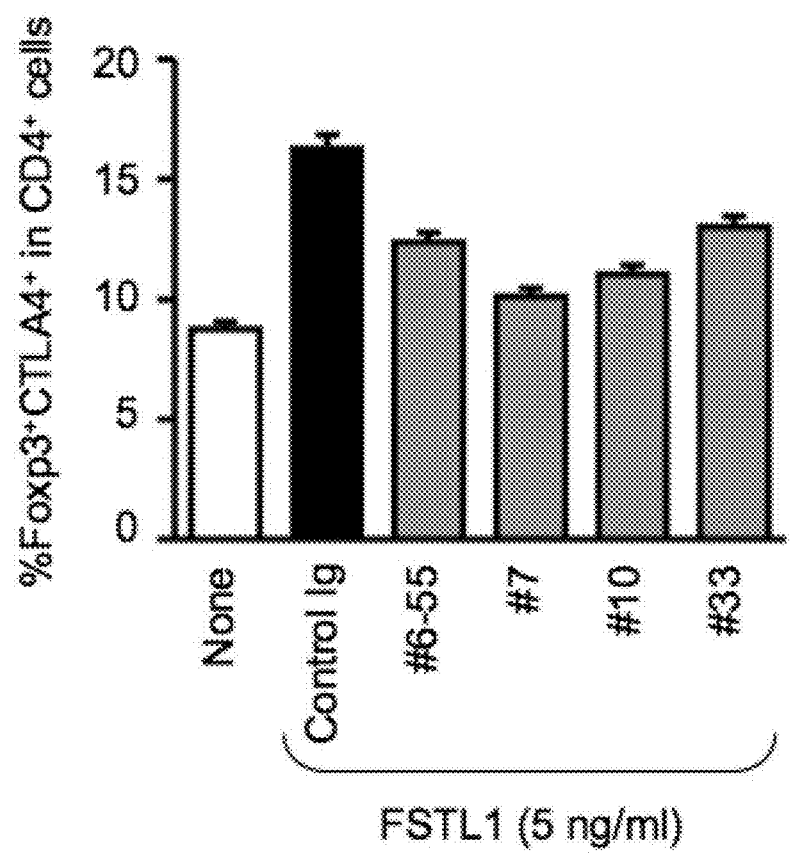

FIG. 116 shows results of a Treg induction inhibition test using mouse spleen cells. The graph shows the percentage of Foxp3+CTLA4+ cells in CD4+ cells. The leftmost bar depicts none, and the second bar from the left to the rightmost bar show results of the experiment in the presence of FSTL (5 ng/ml). Mouse immunoglobulin, and the antibody #6-55, #7, #10, and #13 of the present invention are depicted in order from the second bar from the left.

Figure 117:
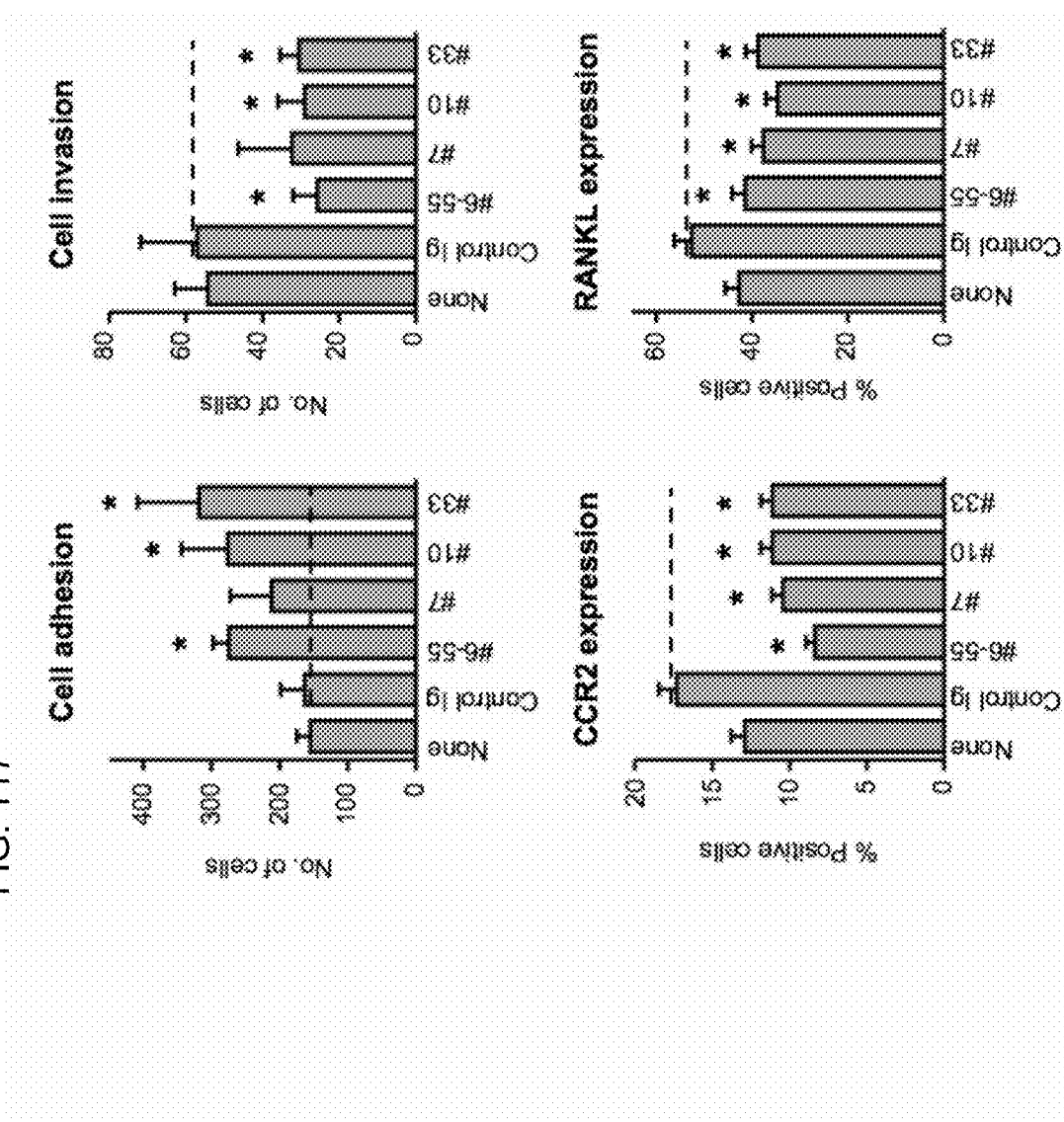

FIG. 117 shows results of evaluating newly prepared 3 anti-FSTL1 antibodies (#7, #10, and #33) differing in epitope for their inhibitory activity against mouse tumor activation. The upper left graph shows cell adhesion, the upper right graph shows cell invasion, the lower left graph shows CCR2 expression, and the lower right graph shows RANKL expression. In each graph, none, control immunoglobulin, and the antibody #6-55, #7, #10, and #33 of the present invention are depicted from the left to the right. * represents statistical significance ($p<0.05$).

Figure 118A:
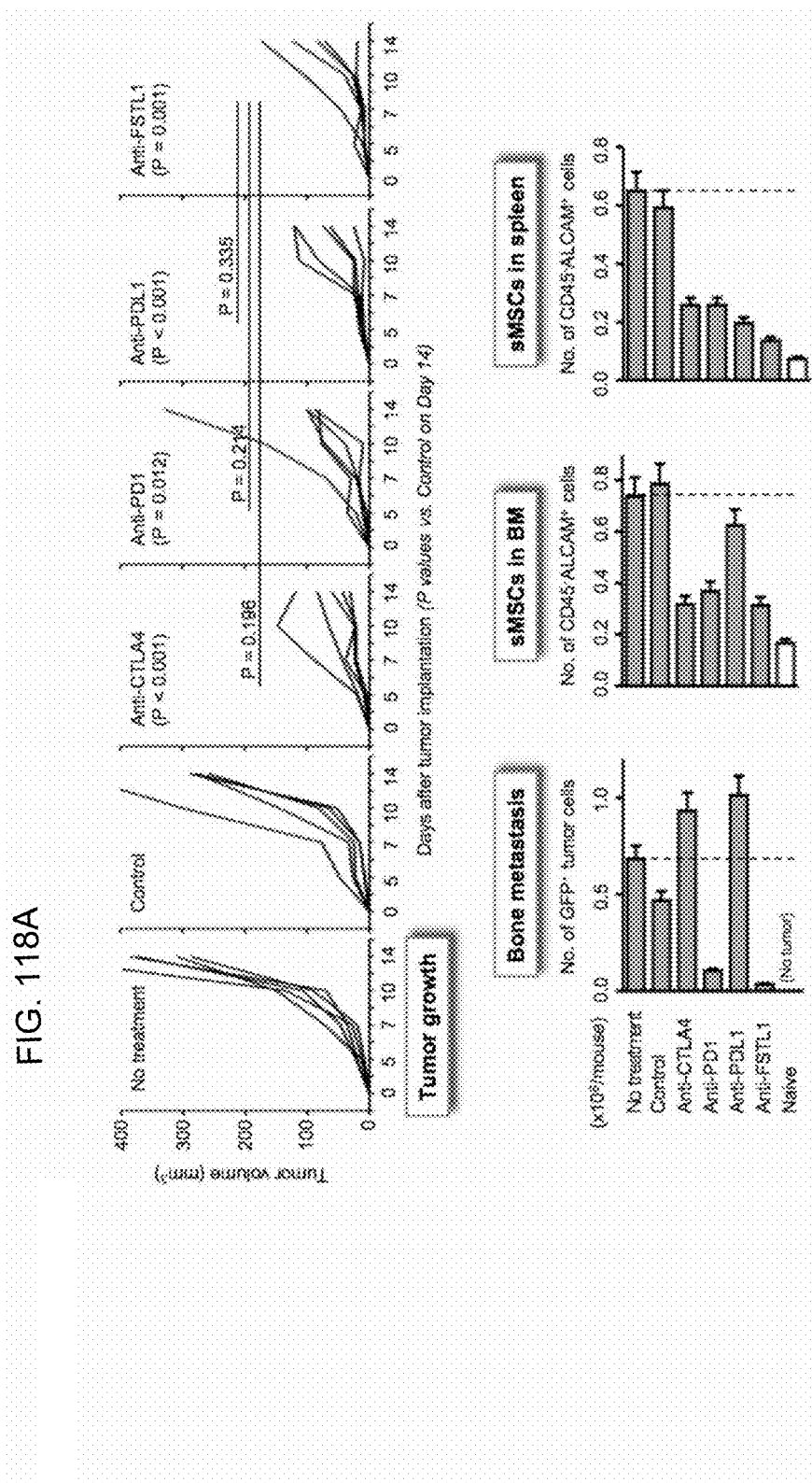

FIGS. 118A to 118D) show results of comparing in vivo drug efficacy between antibody drugs for immune mitigation already used clinically and an anti-FSTL1 antibody using Snail+ tumor bone metastasis models. In FIG. 118A, the upper graphs show tumor growth, and the lower graphs show bone metastasis, sMSCs in bone marrow, and sMSCs in the spleen. In the upper graphs of the tumor growth, no treatment, a control, an anti-CTLA4 antibody, an anti-PD1 antibody, an anti-PD-L1 antibody, and the anti-FSTL1 antibody are depicted from the left to the right. Statistical significance is indicated by p value. The x-axis shows the number of days after tumor implantation (the p values are values of day 14). The y-axis shows tumor volume ($mm^3$). As for the bone metastasis and two sMSC grafts, no treatment, a control, an anti-CTLA4 antibody, an anti-PD1 antibody, an anti-PD-L1 antibody, the anti-FSTL1 antibody, and naive (non-tumor model) are also depicted from the upper to lower bars. The abscissas show the number of GFP+ tumor cells, the number of CD45−ALCAM+ cells, and the number of CD45−ALCAM+ cells, respectively.

Figure 118B:
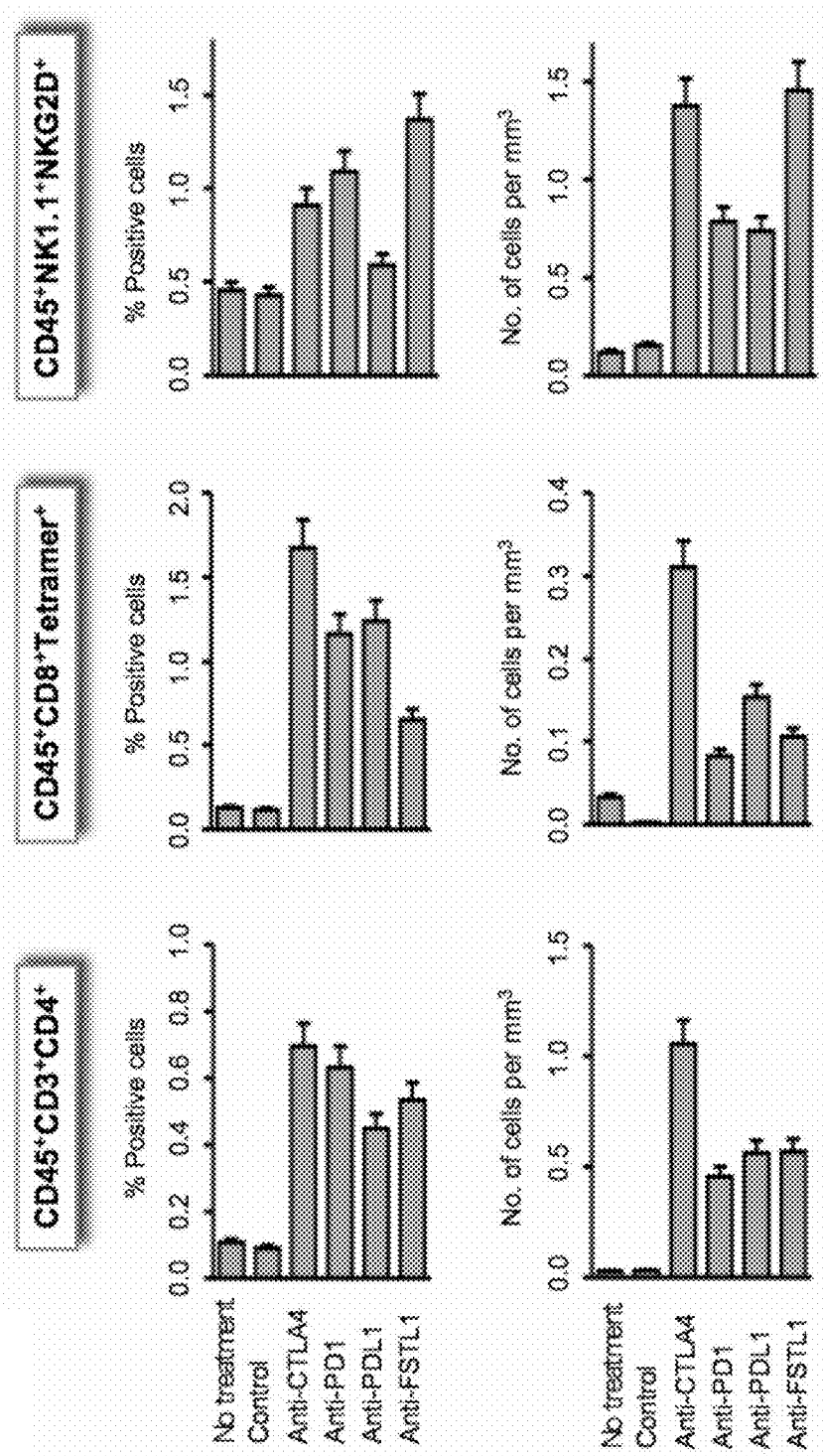

FIG. 118B shows cell groups in charge of antitumor immunity that invaded tumor. CD4+ T cells (CD45+CD3+ CD4+ cells), tumor-specific CD8+ T cells (CD45+CD8+ tetramer+), and activated NK cells (CD45+NK1.1+ NKG2D+) are depicted from the left to the right. The upper graphs show the percentage of positive cells. The lower graphs show the number of cells per $mm^3$. In each graph, no treatment, a control, an anti-CTLA4 antibody, an anti-PD1 antibody, an anti-PD-L1 antibody, and the anti-FSTL1 antibody are depicted from the upper to lower bars.

Figure 118C:
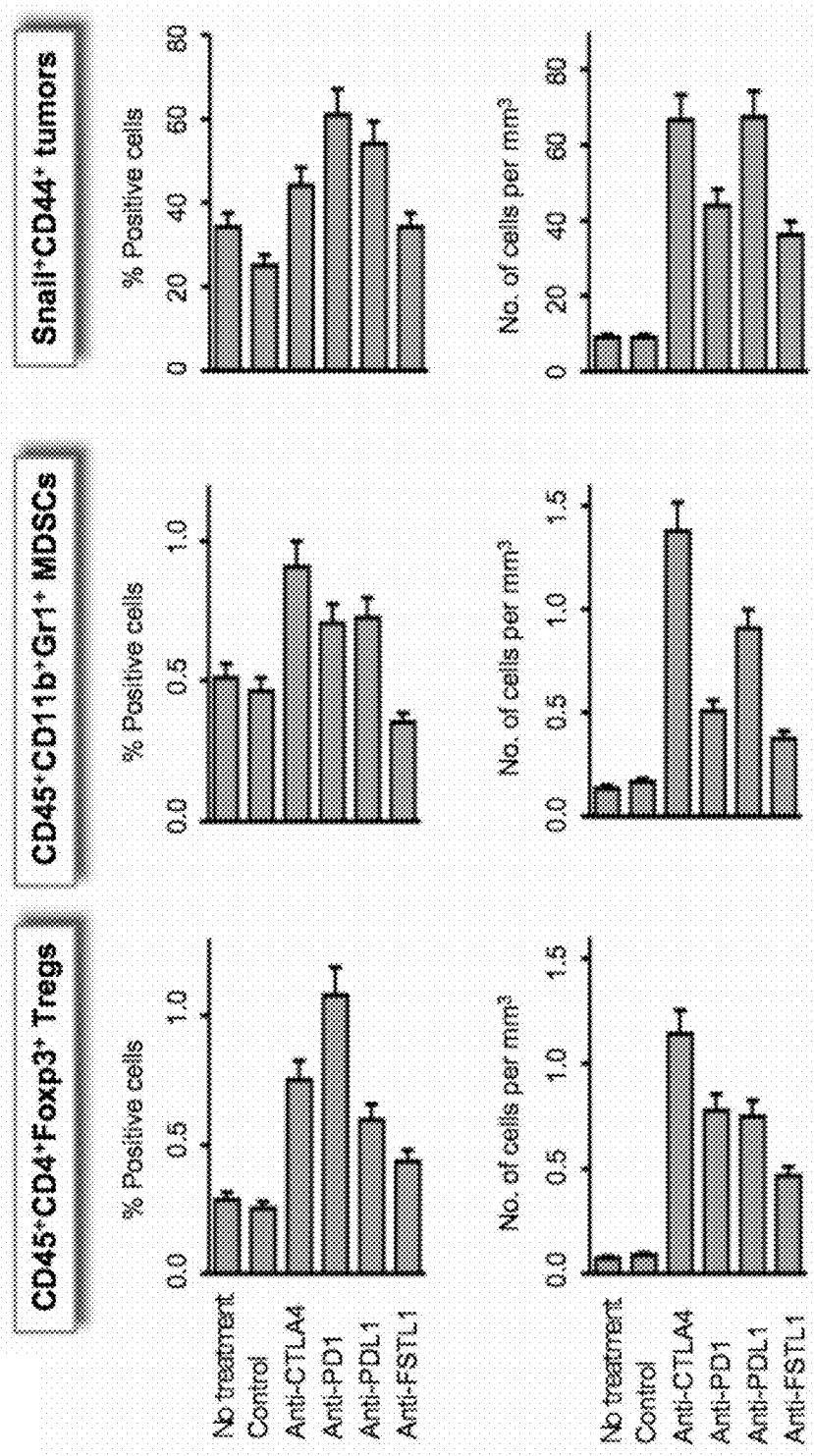

FIG. 118C shows results of the same experiment as in FIG. 118B and shows the results about an immunosuppressive T cell group that invaded tumor and highly metastatic tumor cells in subcutaneous tumor. CD4+ Tregs (CD45+ CD4+Foxp3+ Tregs), MDSCs (CD45+CD11b+Gr1+ MDSCs), and tumor cells having EMT (Snail+CD44+ tumors) are depicted from the left to the right. The description of the graphs is the same as in FIG. 118B. No treatment, a control, an anti-CTLA4 antibody, an anti-PD1 antibody, an anti-PD-L1 antibody, and the anti-FSTL1 antibody are depicted from the upper to lower bars.

Figure 118D:
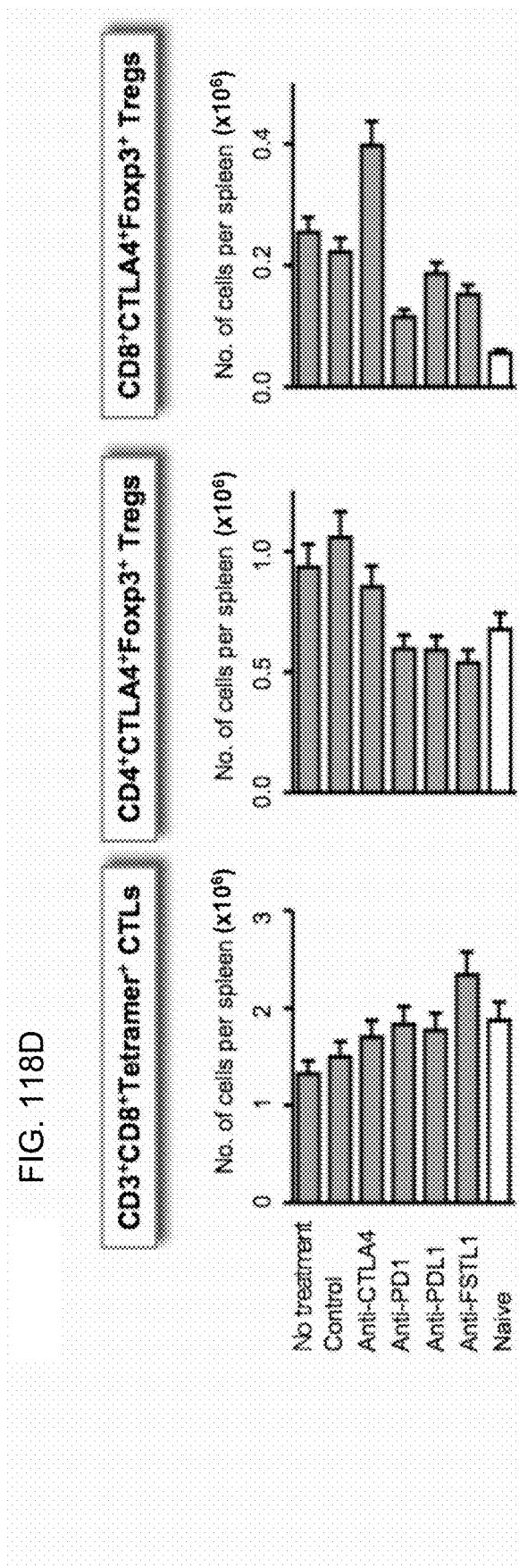

FIG. 118D shows results obtained in immunocyte groups in the spleen. Tumor-specific CD8+ T cells (CD3+CD8+ tetramer+ CTLs), CD4+ Tregs (CD4+CTLA4+Foxp+ Tregs), and CD8+ Tregs (CD8+CTLA4+Foxp3+ Tregs) are depicted from the left to the right. The graphs show the number of cells per spleen (indicated by $\times 10^6$). No treatment, a control, an anti-CTLA4 antibody, an anti-PD1 antibody, an anti-PD-L1 antibody, and the anti-FSTL1 antibody are depicted from the upper to lower bars.

Figure 119:
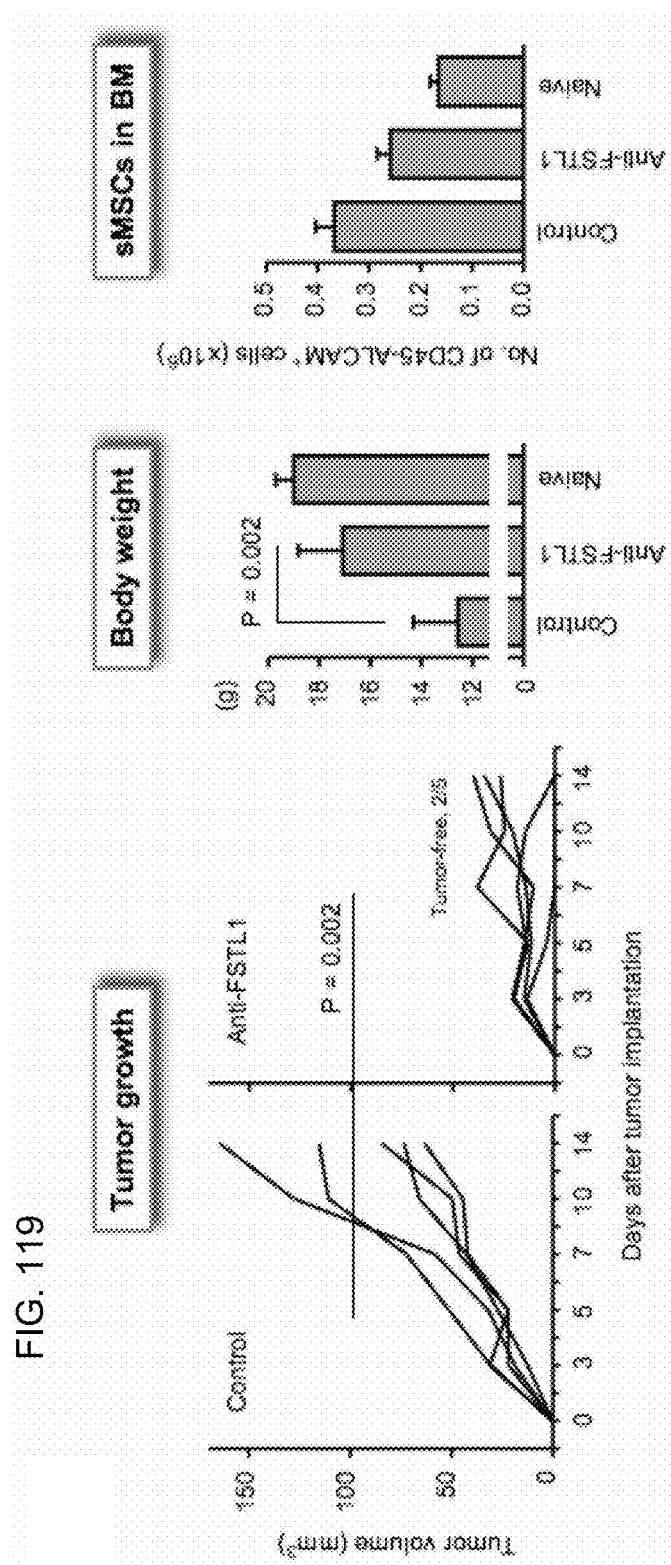

FIG. 119 shows results of evaluating drug efficacy (tumor growth, body weight, and the number of sMSCs in bone marrow) using mouse lung cancer models. For the tumor growth, statistical significance is indicated by p value. A control is depicted on the left, and an anti-FSTL1 antibody is depicted on the right. The abscissa shows the number of days after tumor implantation. The ordinate shows tumor volume ($mm^3$). The middle graph shows animal body weight. A control, an antibody FSTL1 antibody, and naive are depicted from the left to the right. The body weight is indicated by g. The right graph shows sMSCs in bone marrow. A control, an anti-FSTL1 antibody, and naive are depicted from the left to the right. The number of CD45⁻ ALCAM⁺ cells ($\times 10^6$) is shown.

Figure 120:
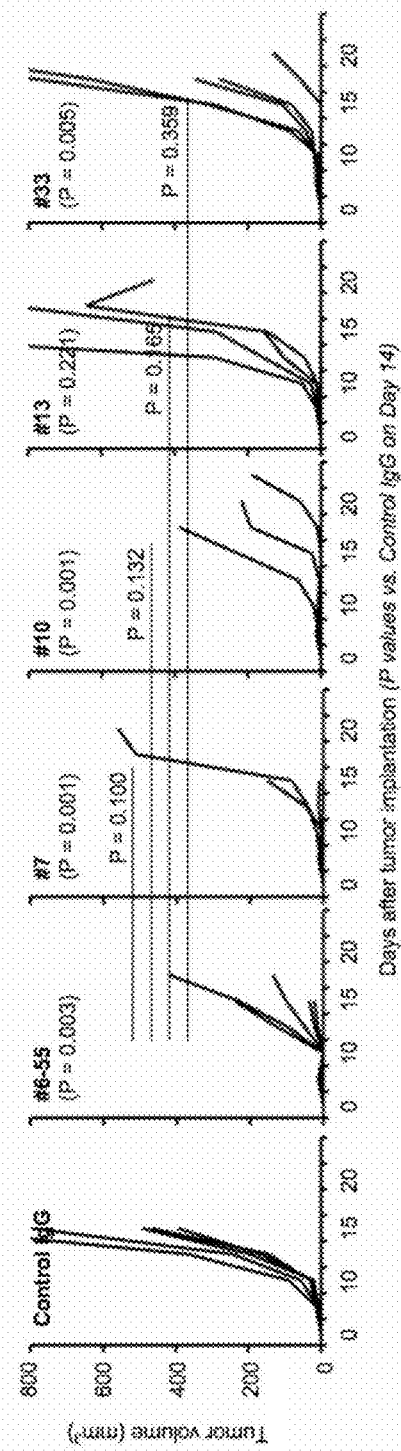
Figure 121:
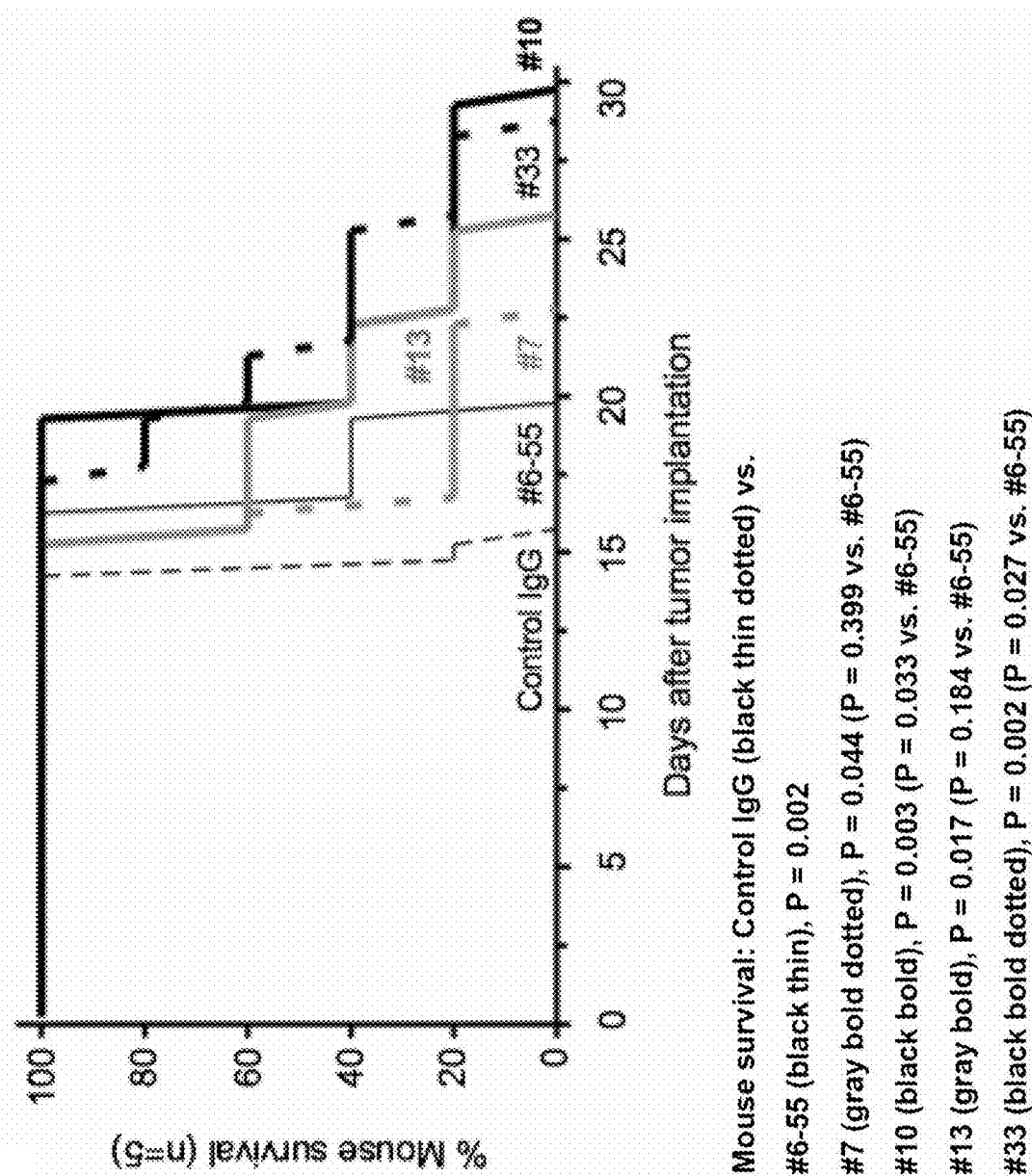

FIG. 120 FIGS. 120 and 121 show the results of evaluating the in vivo drug efficacy of each anti-FSTL1 antibody clone using Snail+ tumor bone metastasis models. FIG. 120 shows change in tumor volume ($mm^3$) after tumor implantation. The results about control immunoglobulin and the antibody #6-55, #7, #10, #13, and #33 of the present invention are shown from the left to the right. Statistical significance (p value) compared with a control is indicated within parentheses, and statistical significance vs. #6-55 is connected by a line and indicated by p value. The abscissa shows the number of days after tumor implantation.

FIG. 121 FIGS. 120 and 121 show the results of evaluating the in vivo drug efficacy of each anti-FSTL1 antibody clone using Snail+ tumor bone metastasis models. FIG. 121 shows survival rate. The abscissa shows the number of days after tumor implantation. The ordinate shows mouse survival rate (n=5). The results about control immunoglobulin and the antibody #6-55, #7, #10, #13, and #33 of the present invention are shown. Statistical significance values (p value) vs. the control immunoglobulin are indicated by black thin dotted line for #6-55, gray bold dotted line for #7, black bold line for #10, gray bold line for #13, and black bold dotted line for #33 with statistical significance (p value) vs. #6-55 indicated within parentheses.

Figure 122:
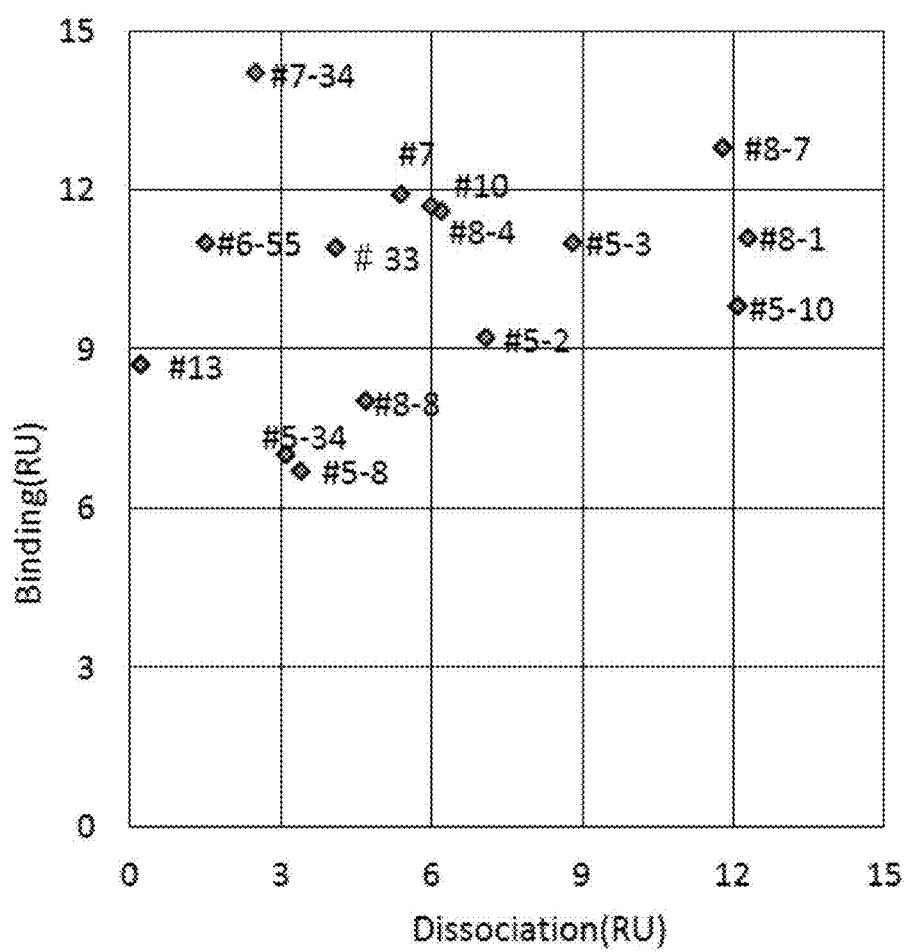

FIG. 122 shows affinity data (determined by BIACORE) on mouse chimeric antibodies. The figure is a plot of the antigen binding amounts and dissociation amounts of the mouse chimeric antibodies.

Figure 123:
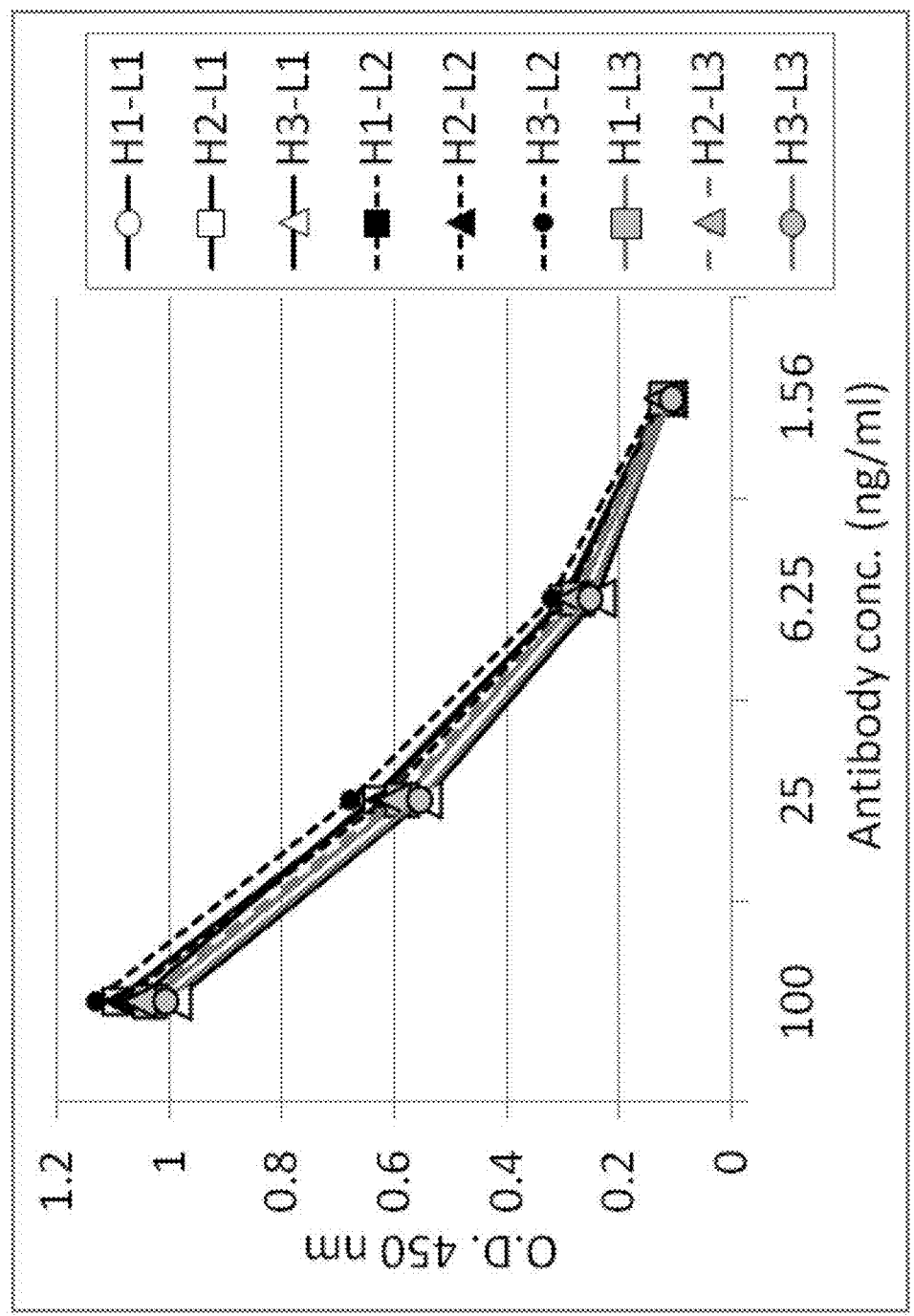
Figure 124:
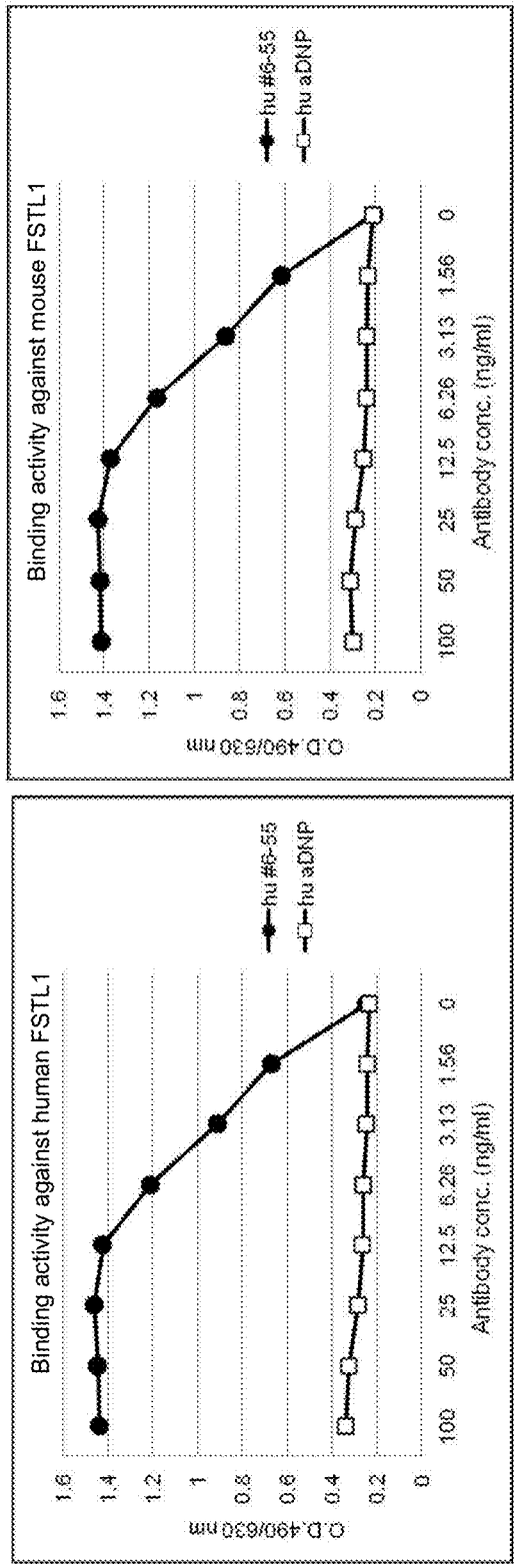

FIG. 123 FIGS. 123 and 124 show results of humanized antibodies. FIG. 123 shows results of comparing binding activity using combinations of humanized 6-55 antibody H chains (IgG1 type) and L chains. The open circle with the dotted line shows the results about humanized antibody H1-L1, the square with the bold line shows the results about H2-L1, the open triangle with the bold line shows the results about H3-L1. Antibody concentrations are indicated on the abscissa, and OD450 values are indicated. H2-L1 was found to be best.

FIG. 124 FIGS. 123 and 124 show results of humanized antibodies. FIG. 124 shows the binding activity of humanized #6-55 H2-L1 (IgG1 type) of the antibody of the present invention against human and mouse FSTL1. The left graph shows the binding activity against human FSTL1, and the right graph shows the binding activity against mouse FSTL1. In both graphs, the filled circle depicts a human #6-55 antibody, and the open square depicts a human anti-DNP antibody. Antibody concentrations are indicated on the abscissa, and OD490/630 values are indicated.

Figure 125:
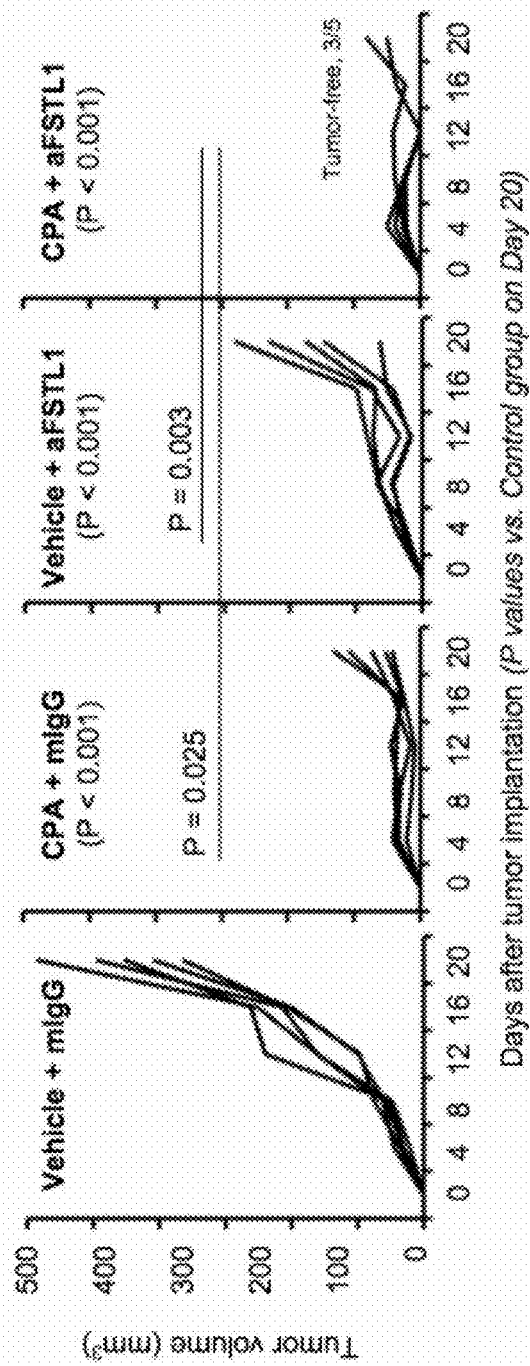

FIG. 125 shows results indicating effects brought about by combined use with CPA in subcutaneously mouse lung cancer 3LL-transplanted models. The left graphs respectively depict a combination of a vehicle (0.9% NaCl) and mouse immunoglobulin, a combination of cyclophosphamide and mouse immunoglobulin, and a combination of the vehicle and an anti-FSTL1 antibody, and the rightmost graph depicts a combination of cyclophosphamide and the anti-FSTL1 antibody. The ordinate shows tumor volume. The abscissa shows the number of days after tumor implantation. The numerical values within the parentheses and the numerical values on the lines (indicated by P) represent p values regarding statistical significance (day 14).

Figure 126:
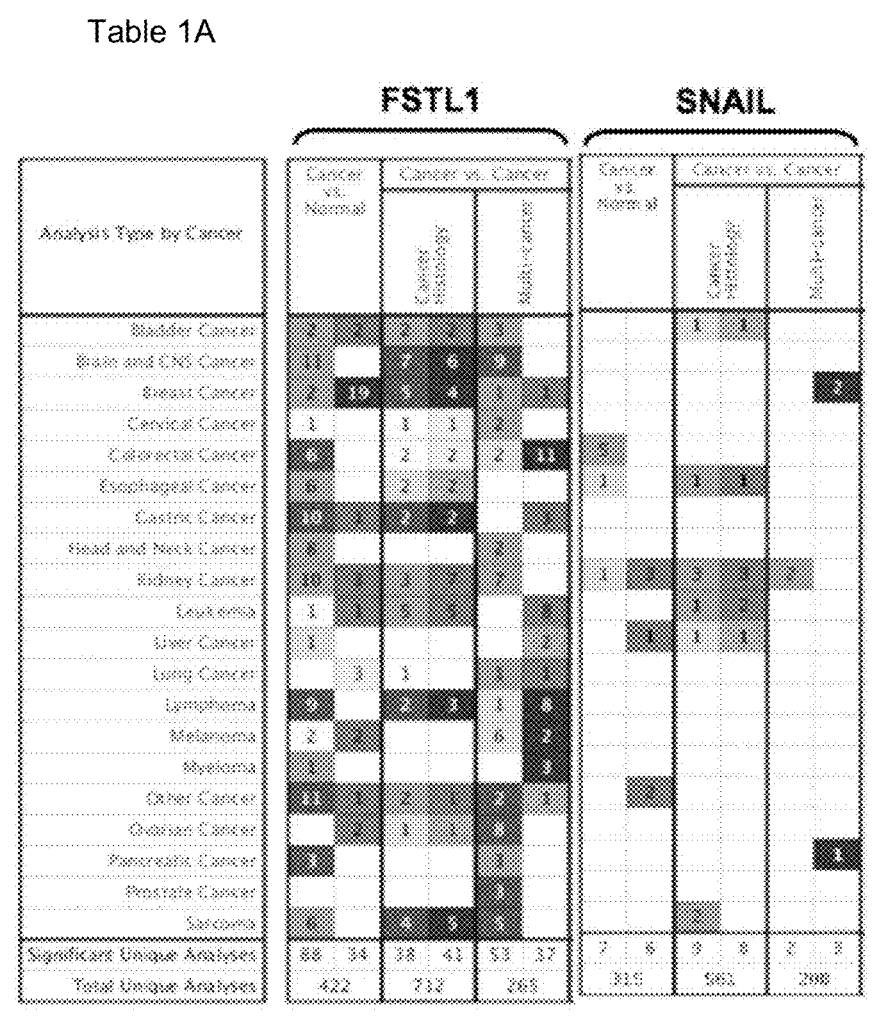

FIG. 126 shows information obtained in the human tumor tissue analysis information site of Oncomine provided by oncomine.com/resource/login.html for the expression of SNAIL and/or FSTL1, and explains that high expression is found in melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma.

DESCRIPTION OF EMBODIMENTS

Hereinafter, the embodiments of the present invention will be described in detail. Description about the same or similar contents will be appropriately omitted in order to avoid cumbersome repetition. It should be understood that the singular form of a word conceptually includes the plural form of the word throughout the present specification unless otherwise specified. Thus, it should be understood that the article of a singular noun (e.g., "a", "an", and "the") conceptually includes even the plural noun thereof unless otherwise specified. It should be understood that terms used herein have meanings usually used in the art unless otherwise specified. Thus, all technical terms and scientific terms used herein have the same meanings as those generally understood by those skilled in the art to which the present invention belongs, unless otherwise defined. If there is any contradiction, the present specification (including definitions) takes a priority.

First, the terms and general techniques used in the present invention will be described.

In the present specification, "FSTL1" gene encodes a protein with similarity to follistatin, an activin binding protein. FSTL1 contains an FS module contained in a follistatin-like sequence and reportedly has 10 conserved cysteine residues. Although the protein is thought to be an autoantigen associated with rheumatoid arthritis, recent findings are described in Patent Literature 1 (WO2009/028411). The accession numbers of FSTL1 described in NCBI are, for example, NP_009016 (NP_009016.1) (amino acid) for humans; NP_032073.2 (amino acid) for mice; NM_007085 (NM_007085.4) (mRNA) for humans; NM_008047.5 (mRNA) for mice. The amino acid sequence of FSTL1 is represented by, for example, SEQ ID NO: 1 or SEQ ID NO: 3. The nucleotide sequence of FSTL1 mRNA is represented by, for example, SEQ ID NO: 2 or SEQ ID NO: 4. FSTL1 is not limited by its amino acid sequence as long as the protein has FSTL1 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

"Derivative", "analog", or "mutant" (or "variant") used herein preferably includes a molecule containing a region substantially homologous to the protein of interest (e.g., FSTL1), though any limitation is not intended. In various embodiments, such a molecule is identical by at least 30%, 40%, 50%, 60%, 70%, 80%, 90%, 95%, or 99% over amino acid sequences of the same sizes or when compared with a sequence aligned by alignment using a computer homology program known in the art, or a nucleic acid encoding such a molecule is capable of hybridizing to a sequence encoding the constituent protein, under (highly) stringent conditions, moderately stringent conditions, or non-stringent conditions. This is a product altered from a naturally occurring protein by amino acid substitution, deletion, and/or addition, and means that the protein derivative still exhibits the biological functions of the naturally occurring protein to the same extent or not to the same extent. The biological functions of such a protein may be examined by, for example, appropriate and available in vitro assay described herein or known in the art. The phrase "functionally active" used herein means that a polypeptide, i.e., a fragment or a derivative, has the structural functions, controlling functions, or biochemical functions of the protein, such as biological activity, according to an aspect related to the polypeptide, i.e., fragment or derivative, of the present invention in the present specification. In the present invention, humans are mainly discussed about FSTL1. However, many non-human animals are known to express FSTL1. Therefore, it is understood that these animals, particularly, mammals, are also included in the scope of the present invention.

Thus, the typical nucleotide sequence of FSTL1 can be
(a) a polynucleotide having the nucleotide sequence represented by SEQ ID NO: 1 or SEQ ID NO: 3 or a fragment sequence thereof;
(b) a polynucleotide encoding a polypeptide consisting of the amino acid sequence represented by SEQ ID NO: 2 or SEQ ID NO: 4 or a fragment thereof;
(c) a polynucleotide encoding an altered polypeptide having one mutation selected from the group consisting of substitution, addition, and deletion of one or more amino acids in the amino acid sequence represented by SEQ ID NO: 2 or SEQ ID NO: 4, or a fragment thereof, the altered polypeptide having biological activity;
(d) a polynucleotide which is a splicing variant or allelic variant of the nucleotide sequence represented by SEQ ID NO: 1 or SEQ ID NO: 3, or a fragment thereof;
(e) a polynucleotide encoding a homolog of a polypeptide consisting of the amino acid sequence represented by SEQ ID NO: 2 or SEQ ID NO: 4, or a fragment thereof;
(f) a polynucleotide that hybridizes under stringent conditions to any one of the polynucleotides (a) to (e) and encodes a polypeptide having biological activity; or
(g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.

In this context, the biological activity typically refers to activity possessed by FSTL1 or means that a marker can be differentiated from other proteins present in the same organism.

The amino acid sequence of FSTL1 can be
(a) a polypeptide consisting of the amino acid sequence represented by SEQ ID NO: 2 or SEQ ID NO: 4 or a fragment thereof;
(b) a polypeptide that has one mutation selected from the group consisting of substitution, addition, and deletion of one or more amino acids in the amino acid sequence represented by SEQ ID NO: 2 or SEQ ID NO: 4, and has biological activity;
(c) a polypeptide encoded by a splicing variant or allelic variant of the nucleotide sequence represented by SEQ ID NO: 1 or SEQ ID NO: 3;
(d) a polypeptide which is a homolog of the amino acid sequence represented by SEQ ID NO: 2 or SEQ ID NO: 4; or
(e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.

In this context, the biological activity typically refers to activity possessed by FSTL1 or means that a marker can be differentiated from other proteins present in the same organism (e.g., an antigen used contains a region capable of functioning as a specific epitope). SEQ ID NOs: 1 to 4 each encode or represent a precursor containing a leader sequence. The first 20 amino acids (methionine to alanine) in SEQ ID NO: 2 and the first 18 amino acids (methionine to glycine) in SEQ ID NO: 4 are leader sequences. Thus, in the present invention, the amino acid sequence of the term FSTL1 may refer to a sequence after deletion of the leader sequence.

In relation to the present invention, "substance binding to FSTL1", "FSTL1 binding agent", or "FSTL1 interacting molecule" is a molecule or a substance binding to FSTL1 at least transiently. Preferably, it is advantageous for detection to be able to display binding (e.g., to be labeled or be a labelable state), and it is advantageous for treatment to be further bound with an agent for treatment. Examples of the substance binding to FSTL1 can include antibodies, antisense oligonucleotides, siRNA, low-molecular-weight molecules (LMW), binding peptides, aptamers, ribozymes, and peptidomimetics. The substance binding to FSTL1 or the "FSTL1 interacting molecule may be an inhibitor of FSTL1 and also includes, for example, a binding protein or a binding peptide directed to FSTL1, particularly, directed to an active site of FSTL1, and a nucleic acid directed to the FSTL1 gene. The nucleic acid against FSTL1 refers to, for example, double-stranded or single-stranded DNA or RNA inhibiting the expression of the FSTL1 gene or the activity of FSTL1, or a modified form or derivative thereof, and further includes, but is not limited to, an antisense nucleic acid, an aptamer, siRNA (small interfering RNA), and a ribozyme. In the present specification, "binding protein" or "binding peptide" as to FSTL1 refers to an arbitrary protein or peptide binding to FSTL1 and further includes, but is not limited to, an antibody (e.g., a polyclonal antibody or a monoclonal antibody), an antibody fragment, and a functional equivalent directed to FSTL1.

In the present specification, "protein", "polypeptide", "oligopeptide", and "peptide" are used herein interchangeably with each other and refer to an amino acid polymer having an arbitrary length. This polymer may be linear or branched or may be cyclic. The amino acid may be natural or non-natural or may be an altered amino acid. This term may also encompass an assembly of a plurality of polypeptide chains as a complex. This term also encompasses a naturally or artificially altered amino acid polymer. Such alteration encompasses, for example, disulfide bond formation, glycosylation, lipidation, acetylation, phosphorylation, or any other operation or alteration (e.g., conjugation with a labeling component). This definition also encompasses, for example, a polypeptide containing analogs of one or two or more amino acids (including e.g., a non-natural amino acid), a peptide-like compound (e.g., a peptoid), and other alterations known in the art. In the present specification, "amino acid" is a generic name for organic compounds having amino and carboxyl groups. When the antibody according to the embodiments of the present invention comprises "particular amino acid sequence", any amino acid in the amino acid sequence may receive chemical modification. Also, any amino acid in the amino acid sequence may form a salt or a solvate. Also, any amino acid in the amino acid sequence may be in a L- or D-form. In such cases, the protein according to the embodiments of the present invention is also interpreted to comprise the "particular amino acid sequence" described above. For example, N-terminal modification (e.g., acetylation and myristoylation), C-terminal modification (e.g., amidation and glycosylphosphatidylinositol addition), or side chain modification (e.g., phosphorylation and glycosylation) is known as the in vivo chemical modification of amino acids contained in proteins. The modification may be natural or non-natural as long as the object of the present invention is met.

In the present specification, "polynucleotide", "oligonucleotide", and "nucleic acid" are used herein interchangeably with each other and refer to a nucleotide polymer having an arbitrary length. This term also includes "oligonucleotide derivative" or "polynucleotide derivative". "Oligonucleotide derivative" or "polynucleotide derivative" refers to an oligonucleotide or a polynucleotide that contains a nucleotide derivative or has an internucleotide bond different from a usual one, and is used interchangeably. Specific examples of such an oligonucleotide include 2'-O-methyl-ribonucleotide, an oligonucleotide derivative in which a phosphodiester bond in an oligonucleotide has been converted to a phosphorothioate bond, an oligonucleotide derivative in which a phosphodiester bond in an oligonucleotide has been converted to a N3'-P5' phosphoramidate bond, an oligonucleotide derivative in which ribose and a phosphodiester bond in an oligonucleotide have been converted to a peptide nucleic acid bond, an oligonucleotide derivative in which uracil in an oligonucleotide has been replaced with C-5 propynyluracil, an oligonucleotide derivative in which uracil in an oligonucleotide has been replaced with C-5 thiazoleuracil, an oligonucleotide derivative in which cytosine in an oligonucleotide has been replaced with C-5 propynylcytosine, an oligonucleotide derivative in which cytosine in an oligonucleotide has been replaced with phenoxazine-modified cytosine, an oligonucleotide derivative in which ribose in DNA has been replaced with 2'-O-propylribose, and an oligonucleotide derivative in which ribose in an oligonucleotide has been replaced with 2'-methoxyethoxyribose. A particular nucleic acid sequence is also intended to encompass an explicitly shown sequence as well as a conservatively altered form (e.g., a degenerate codon substitution variant) and a complementary sequence thereof, unless otherwise specified. Specifically, the degenerate codon substitution variant can be achieved by preparing a sequence in which the third position of one or more selected (or all) codons has been replaced with a mixed base and/or a deoxyinosine residue (Batzer et al., Nucleic Acid Res. 19: 5081 (1991); Ohtsuka et al., J. Biol. Chem. 260: 2605-2608 (1985); and Rossolini et al., Mol. Cell. Probes 8: 91-98 (1994)). In the present specification, "nucleic acid" is also used interchangeably with a gene, cDNA, mRNA, an oligonucleotide, and a polynucleotide. In the present specification, "nucleotide" may be natural or non-natural.

In the present specification, "gene" refers to an agent that governs genetic traits. "Gene" may refer to "polynucleotide", "oligonucleotide", and "nucleic acid".

In the present specification, "homology" of genes refers to the degree of identity between two or more gene sequences. In general, having "homology" means that the degree of identity or similarity is high. Thus, as the homology of two certain genes is higher, the identity or similarity of their sequences is higher. Whether or not two types of genes have homology can be examined by the direct comparison of their sequences or hybridization under stringent conditions for nucleic acids. In the case of directly comparing two gene sequences, these genes have homology when their DNA sequences are identical by typically at least 50%, preferably at least 70%, more preferably at least 80%, 90%, 95%, 96%, 97%, 98%, or 99% between the gene sequences. Thus, in the present specification, "homolog" or "homologous gene product" means a protein of another species, preferably a mammalian protein, which exerts the same biological functions as those of a protein constituent of a complex further described herein. Such a homolog is also referred to as "ortholog gene product". It is understood that such a homolog, a homologous gene product, an ortholog gene product, or the like can also be used as long as the object of the present invention is met.

An amino acid can be mentioned herein by a generally known three-letter code thereof or a one-letter code recommended by IUPAC-IUB Biochemical Nomenclature Commission. Likewise, a nucleotide may be mentioned by a generally recognized one-letter code. In the present specification, the comparison of similarity, identity, and homology between amino acid sequences and nucleotide sequences is calculated using a tool BLAST for sequence analysis with default parameters. Identity search can be performed using, for example, NCBI BLAST 2.2.28 (issued on Apr. 2, 2013). In the present specification, the value of identity usually refers to a value obtained by alignment under default conditions using the BLAST described above. However, in the case where a higher value is obtained by change of a parameter, the highest value is used as the value of identity. In the case where identity is evaluated for a plurality of regions, the highest value thereamong is used as the value of identity. The similarity is a numerical value calculated by including similar amino acids in addition to the identity.

In one embodiment of the present invention, the term "several" may be, for example, 10, 8, 6, 5, 4, 3, or 2 or may be equal to or less than any of these values. A polypeptide that has undergone the deletion, addition, or insertion of 1 or several amino acid residues, or the substitution of 1 or several amino acid residues by other amino acids is known to maintain its biological activity (Mark et al., Proc Natl Acad Sci USA. 1984 September; 81 (18): 5662-5666; Zoller et al., Nucleic Acids Res. 1982 Oct. 25; 10 (20): 6487-6500; and Wang et al., Science. 1984 Jun. 29; 224 (4656): 1431-1433.). An antibody that has undergone deletion, etc. can be prepared by, for example, site-directed mutagenesis, random mutagenesis, or biopanning using antibody phage libraries. For example, KOD-Plus-Mutagenesis Kit (Toyobo Co., Ltd.) can be used in the site-directed mutagenesis. The selection of an antibody having activity similar to that of wild type from mutant-type antibodies in which deletion, etc. has been introduced can be achieved by various characterization techniques such as FACS analysis or ELISA.

In one embodiment of the present invention, the phrase "90% or higher" may be, for example, 90, 95, 96, 97, 98, 99, or 100% or higher and may be within the range of any two of these values. The "homology" described above may be calculated as the percentage of the number of homologous amino acids between two or more amino acid sequences according to a method known in the art. Before the calculation of the percentage, a gap is introduced to a portion of amino acid sequences, if required, in order to align the amino acid sequences of an amino acid sequence group for comparison and maximize the percentage of identical amino acids. A method for alignment, a method for calculating the percentage, a comparison method, and a computer program associated therewith have heretofore been well known in the art (e.g., BLAST and GENETYX). In the present specification, "homology" can be represented by a value measured by NCBI BLAST, unless otherwise specified. Default setting of Blastp can be used in algorithms for comparing amino acid sequences by BLAST. The measurement results are converted to numerical values as positives or identities.

In the present specification, "polynucleotide hybridizing under stringent conditions" refers to well-known conditions conventionally used in the art. Such a polynucleotide can be obtained by use of colony hybridization, plaque hybridization, Southern blot hybridization, or the like using a polynucleotide selected from among the polynucleotides of the present invention as a probe. Specifically, the polynucleotide means a polynucleotide that can be identified by hybridization at 65° C. in the presence of 0.7 to 1.0 M NaCl using a colony- or plaque-derived DNA-immobilized filter, followed by the washing of the filter under 65° C. conditions using a 0.1 to 2×SSC (saline-sodium citrate) solution (the composition of a 1×SSC solution is 150 mM sodium chloride and 15 mM sodium citrate). "Stringent conditions" can adopt, for example, the following conditions: (1) low ion strength and high temperature are used for washing (e.g., 0.015 M sodium chloride/0.0015 M sodium citrate/0.1% sodium dodecyl sulfate at 50° C.), (2) a denaturant such as formamide is used in hybridization (e.g., 50% (v/v) formamide, 0.1% bovine serum albumin/0.1% Ficoll/0.1% polyvinylpyrrolidone/50 mM sodium phosphate buffer (pH 6.5), 750 mM sodium chloride, and 75 mM sodium citrate at 42° C.), or (3) the filter is incubated overnight at 37° C. in a solution containing 20% formamide, 5×SSC, 50 mM sodium phosphate (pH 7.6), a 5×Denhardt's solution, 10% dextran sulfate, and 20 mg/ml of denatured sheared salmon sperm DNA, and then washed with 1×SSC at approximately 37 to 50° C. The formamide concentration may be 50% or higher. The washing time may be 5, 15, 30, 60, or 120 minutes or longer. A plurality of factors such as temperature and salt concentration are possible as factors that influence the stringency of hybridization reaction. For the details, see Ausubel et al., Current Protocols in Molecular Biology, Wiley Interscience Publishers, (1995). An example of "highly stringent conditions" is 0.0015 M sodium chloride and 0.0015 M sodium citrate at 65 to 68° C., or 0.015 M sodium chloride, 0.0015 M sodium citrate, and 50% formamide at 42° C. The hybridization can be performed according to a method described in an experimental manual such as Molecular Cloning 2nd ed., Current Protocols in Molecular Biology, Supplement 1-38, or DNA Cloning 1: Core Techniques, A Practical Approach, Second Edition, Oxford University Press (1995). In this context, preferably, a sequence comprising only an A sequence or only a T sequence is excluded from a sequence hybridizing under stringent conditions. Moderately stringent conditions can be readily determined by those skilled in the art on the basis of, for example, the length of DNA, and are shown in Sambrook et al., Molecular Cloning: A Laboratory Manual, 3rd ed., Vol. 1, 7.42-7.45 Cold Spring Harbor Laboratory Press, 2001. As for a nitrocellulose filter, the moderately stringent conditions include use of hybridization conditions involving a prewashing solution of 5×SSC, 0.5% SDS, and 1.0 mM EDTA (pH 8.0), and approximately 50% formamide and 2×SSC to 6×SSC at approximately 40 to 50° C. (or any other similar hybridization solution such as a Stark's solution in approximately 50% formamide at approximately 42° C.), and washing conditions involving approximately 60° C., 0.5×SSC, and 0.1% SDS. Thus, the polypeptide used in the present invention also encompasses a polypeptide encoded by a nucleic acid molecule hybridizing under highly or moderately stringent conditions to a nucleic acid molecule encoding the polypeptide particularly described in the present invention.

In the present specification, "purified" substance or biological agent (e.g., nucleic acid or protein) refers to the substance or biological agent from which at least a portion of natural accompaniments has been removed. Thus, for the purified biological agent, the purity of the biological agent is usually higher than that in a state where the biological agent is normally present (i.e., the biological agent is concentrated). The term "purified" used herein means that preferably at least 75% by weight, more preferably at least 85% by weight, still more preferably at least 95% by weight, most preferably at least 98% by weight of a homotypic biological agent is present. The substance or biological agent used in the present invention is preferably a "purified" substance. "Isolated" substance or biological agent (e.g., nucleic acid or protein) used herein refers to the substance or biological agent from which natural accompaniments have been substantially removed. The term "isolated" used herein varies depending on the purpose and therefore, is not necessarily required to be indicated by purity. If necessary, this term means that preferably at least 75% by weight, more preferably at least 85% by weight, still more preferably at least 95% by weight, most preferably at least 98% by weight of a homotypic biological agent is present. The substance used in the present invention is preferably an "isolated" substance or biological agent.

In the present specification, "corresponding" amino acid or nucleic acid, or moiety refers to an amino acid or a nucleotide having or presumed to have action similar to that of a predetermined amino acid or nucleotide, or moiety in a reference polypeptide or polynucleotide for comparison, in a certain polypeptide molecule or polynucleotide molecule (e.g., FSTL1). Particularly, this term refers to an amino acid that is located at a similar position in an active site and similarly contributes to catalytic activity, for an enzyme molecule, and refers to a corresponding moiety (e.g., a transmembrane domain) for a complex molecule. For example, for an antisense molecule, the corresponding amino acid or nucleic acid, or moiety can be a similar moiety in an ortholog corresponding to a particular moiety of the antisense molecule. The corresponding amino acid can be, for example, a particular amino acid that undergoes cysteinylation, glutathionylation, S—S bond formation, oxidation (e.g., oxidation of a methionine side chain), formylation, acetylation, phosphorylation, glycosylation, myrstylation, or the like. Alternatively, the corresponding amino acid may be an amino acid in charge of dimerization. Such "corresponding" amino acid or nucleic acid may be a region or a domain that spans a given range. Thus, in such a case, the corresponding amino acid or nucleic acid is referred herein to as "corresponding" region or domain. In the present invention, such a corresponding region or domain is useful for designing a complex molecule.

In the present specification, "corresponding" gene (e.g., polynucleotide sequence or molecule) refers to a gene (e.g., polynucleotide sequence or molecule) having or presumed to have action similar to a predetermined gene in a reference species for comparison, in a certain species. In the case where a plurality of genes having such action are present, the corresponding gene refers to a gene having evolutionarily the same origin. Thus, a gene corresponding to a certain gene can be an ortholog of the gene. Thus, human FSTL1 can be found as corresponding FSTL1 in other animals (particularly, mammals). Such a corresponding gene can be identified by use of a technique well known in the art. Thus, for example, a corresponding gene in a certain animal (e.g., mouse) can be found by using sequences such as SEQ ID NOs: 1 to 4 as query sequences for a reference gene (e.g., FSTL1) of the corresponding gene and searching a database involving the sequences of the animal.

In the present specification, "fragment" refers to a polypeptide or a polynucleotide having a sequence length of 1 to n−1 with respect to a full-length polypeptide or polynucleotide (length: n). The length of the fragment can be appropriately changed according to the purpose. Examples of the lower limit of the length of the polypeptide include 3, 4, 5, 6, 7, 8, 9, 10, 15, 20, 25, 30, 40, and 50 or more amino acids. A length represented by an integer that is not specifically listed here (e.g., 11) may also be appropriate for the lower limit. Examples of the lower limit of the length of the polynucleotide include 5, 6, 7, 8, 9, 10, 15, 20, 25, 30, 40, 50, 75, and 100 or more nucleotides. A length represented by an integer that is not specifically listed here (e.g., 11) may also be appropriate for the lower limit. In the present specification, it is understood that in the case where a full-length molecule functions as, for example, a marker or a target molecule, such a fragment is included in the scope of the present invention as long as the fragment itself also has the functions as a marker or a target molecule.

According to the present invention, the term "activity" refers to a function of a molecule in the broadest sense in the present specification. The activity generally includes a biological function, a biochemical function, a physical function, or a chemical function of the molecule, though any limitation is not intended. The activity includes, for example, enzymatic activity, the ability to interact with other molecules, the ability to activate, promote, stabilize, inhibit, suppress, or destabilize the functions of other molecules, stability, or the ability to localize to a particular intracellular position. This term also relates to a function of a protein complex in the broadest sense, if applicable.

In the present specification, "biological function" when a certain gene or a nucleic acid molecule or polypeptide related thereto is mentioned refers to a particular function that can be possessed in vivo by the gene, the nucleic acid molecule, or the polypeptide. Examples thereof can include, but are not limited to, production of a specific antibody, enzymatic activity, and conferring of resistance. In the present invention, examples thereof can include, but are not limited to, a function by which FSTL1 is involved in the inhibition of VLDL uptake, etc. In the present specification, the biological function can be exerted by "biological activity". In the present specification, "biological activity" refers to activity that can be possessed in vivo by a certain agent (e.g., polynucleotide and protein). The biological activity encompasses activity that exerts various functions (e.g., transactivating activity) and also encompasses, for example, activity of interacting with a certain molecule to activate or deactivate another molecule. In the case where two agents interact with each other, the biological activity can be the binding between these two molecules and biological change caused thereby. For example, two molecules are considered to be bound with each other when an antibody is precipitated using one of the molecules and also coprecipitated with the other molecule. Thus, the examination of such coprecipitation is one judgment approach. In the case where the certain agent is, for example, an enzyme, the biological activity encompasses its enzymatic activity. In another example, in the case where the certain agent is a ligand, the biological activity encompasses the binding of the ligand to a corresponding receptor. Such biological activity can be measured by a technique well known in the art. Thus, "activity" refers to various measurable indexes that indicate or reveal binding (either directly or indirectly) or influence response (i.e., having measurable influence that responds to any exposure or stimulation). Examples thereof include the affinity of a compound binding directly to the polypeptide or the polynucleotide of the present invention, the amount of an upstream or downstream protein after some stimuli or events, and measures of other similar functions.

In the present specification, "expression" of a gene, a polynucleotide, a polypeptide, or the like means that the gene, etc. assumes a different form by given action in vivo. Preferably, this term means that the gene, the polynucleotide, etc. assumes a polypeptide form through transcription and translation. The preparation of mRNA by transcription is also one form of expression. Thus, in the present specification, "expression product" includes such a polypeptide or a protein, or mRNA. More preferably, such a polypeptide form can be a post-translationally processed form. For example, the expression level of FSTL1 can be determined by an arbitrary method. Specifically, the expression level of FSTL1 can be determined by evaluating the amount of FSTL1 mRNA, the amount of the FSTL1 protein, and the biological activity of the FSTL1 protein. Such a measurement value can be used in companion diagnostics. The amount of the FSTL1 mRNA or protein can be determined by a method described in detail in another section herein or any other method known in the art.

In the present specification, "functional equivalent" refers to an arbitrary form that has an intended function equivalent to that of the original entity of interest, but differs structurally therefrom. Thus, it is understood that a functional equivalent of "FSTL1", or an antibody thereagainst is not FSTL1, or the antibody itself, but encompasses a mutant or altered form (e.g., an amino acid sequence altered form) of FSTL1, or the antibody having biological effects possessed by FSTL1, and a form that can be converted to FSTL1, or the antibody itself, or a mutant or altered form of this FSTL1, or the antibody at the time of acting (including e.g., a nucleic acid encoding FSTL1, or the antibody itself, or a mutant or altered form of this FSTL1, or the antibody, and a vector, a cell, and the like comprising the nucleic acid). In the present invention, it is understood that the functional equivalent of FSTL1, or an antibody thereagainst can be used similarly to FSTL1, or the antibody even if no mentioned so. The functional equivalent can be found by searching a database or the like. In the present specification, "search" refers to utilization of a certain nucleic acid nucleotide sequence electronically or in a biological or any other method to find another nucleic acid nucleotide sequence having a particular function and/or property. Examples of the electronical search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), and Needleman and Wunsch method (Needleman and Wunsch, J. Mol. Biol. 48: 443-453 (1970)). Examples of the biological search include, but are not limited to, stringent hybridization, macroarrays containing genomic DNA attached to nylon membranes or the like or microarrays containing genomic DNA attached to glass sheets (microarray assay), PCR, and in situ hybridization. In the present specification, the gene used in the present invention is intended to also include a corresponding gene identified by such electronical search or biological search.

An amino acid sequence having the insertion, substitution, or deletion of one or more amino acids, or the addition thereof to one or both of the ends can be used in the functional equivalent of the present invention. In the present specification, "amino acid sequence having the insertion, substitution, or deletion of one or more amino acids, or the addition thereof to one or both of the ends" means that the amino acid sequence has been altered by the substitution, etc. of a plurality of amino acids to an extent that can occur naturally by a well-known technical method such as site-directed mutagenesis, or by natural mutation. The altered amino acid sequence can be a sequence that has undergone the insertion, substitution, or deletion of, for example, 1 to 30, preferably 1 to 20, more preferably 1 to 9, further preferably 1 to 5, particularly preferably 1 or 2 amino acids, or the addition thereof to one or both of the ends. The altered amino acid sequence may be preferably an amino acid sequence derived from the amino acid sequence of a polypeptide such as FSTL1 or an antibody by the conservative substitution of one or more (preferably 1 or several or 1, 2, 3, or 4) amino acids. In this context, "conservative substitution" means that one or more amino acid residues are substituted by other amino acid residues chemically similar thereto so as not to substantially alter the functions of the protein. Examples thereof include the substitution of a certain hydrophobic residue by another hydrophobic residue, and the substitution of a certain polar residue by another polar residue having the same electric charge thereas. Functionally similar amino acids that permit such substitution are known in the art about each amino acid. Specific examples thereof include: non-polar (hydrophobic) amino acids such as alanine, valine, isoleucine, leucine, proline, tryptophan, phenylalanine, and methionine; polar (neutral) amino acids such as glycine, serine, threonine, tyrosine, glutamine, asparagine, and cysteine; positively charged (basic) amino acids such as arginine, histidine, and lysine; and negatively charged (acidic) amino acids such as aspartic acid and glutamic acid.

In the present specification, "suppressor" refers to a substance or an agent that inhibits the biological effects of the entity of interest (e.g., receptor or cells). The FSTL1 suppressor of the present invention is an agent that can transiently or permanently reduce or delete the functions of the FSTL1 or FSTL1-expressing cells, etc. of interest. Examples of such an agent can include, but are not limited to, forms of antibodies, antigen binding fragments thereof, derivatives of the antibodies or the fragments, functional equivalents, antisenses, and nucleic acids such as RNAi agents (e.g., siRNA).

In the present specification, "agonist" refers to a substance that exhibits or enhances the biological effects of the entity of interest (e.g., receptor). Examples thereof can include natural agonists (also called ligands) as well as synthesized or altered agonists.

In the present specification, "antagonist" refers to a substance that suppresses or inhibits the exertion of the biological effects of the entity of interest (e.g., receptor). Examples thereof can include natural antagonists as well as synthesized or altered antagonists. The antagonist includes, for example, a substance that performs competitive suppression or inhibition with an agonist (or ligand) as well as a substance that performs non-competitive suppression or inhibition therewith. The antagonist can be obtained by altering the agonist. Because of suppressing or inhibiting physiological phenomena, the antagonist may be conceptually encompassed by a suppressor (inhibitor) or a suppressive (suppressing) agent. Thus, the antagonist is used herein substantially interchangeably with "suppressor".

In the present specification, "antibody" includes a polyclonal antibody, a monoclonal antibody, a multispecific antibody, a chimeric antibody, and an anti-idiotype antibody, and their fragments, for example, a Fv fragment, a Fab' fragment, F(ab')2, and a Fab fragment, and any other conjugate or functional equivalent produced by recombination (e.g., a chimeric antibody, a humanized antibody, a multifunctional antibody, a bispecific or oligospecific antibody, a single-chain antibody, scFv, diabody, sc(Fv)2 (single chain (Fv)2), and scFv-Fc), in a broad sense. Such an antibody may be further covalently bound with or recombinantly fused with an enzyme, for example, alkaline phosphatase, horseradish peroxidase, or a galactosidase. The anti-FSTL1 antibody used in the present invention is not limited by its origin, type, shape, etc. as long as the antibody binds to the FSTL1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "anti-FSTL1 antibody" includes an antibody having binding activity against FSTL1. A method for producing this anti-FSTL1 antibody is not particularly limited, and the antibody may be produced, for example, by immunizing a mammal or bird with FSTL1.

It is also understood that "functional equivalent" of "antibody against FSTL1 (anti-FSTL1 antibody) or fragment thereof" also encompasses, for example, in the case of an antibody, the antibody itself and its fragment itself having binding activity and, if necessary, suppressive activity against FSTL1 as well as a chimeric antibody, a humanized antibody, a multifunctional antibody, a bispecific or oligospecific antibody, a single-chain antibody, scFv, diabody, sc(Fv)2 (single chain (Fv)2), scFv-Fc, and the like.

The anti-FSTL1 antibody according to one embodiment of the present invention is preferably an anti-FSTL1 antibody specifically binding to a particular epitope on FSTL1, from the viewpoint that the growth of malignant tumor is particularly strongly suppressed.

The anti-FSTL1 antibody according to one embodiment of the present invention may be a monoclonal antibody. The monoclonal antibody can be allowed to act on FSTL1 more efficiently than a polyclonal antibody. It is preferred to immunize a chicken with FSTL1, from the viewpoint of efficiently producing the anti-FSTL1 monoclonal antibody.

The antibody class of the anti-FSTL1 antibody according to one embodiment of the present invention is not particularly limited and may be, for example, IgM, IgD, IgG, IgA, IgE, or IgY.

The anti-FSTL1 antibody according to one embodiment of the present invention may be an antibody fragment having antigen binding activity (hereinafter, also referred to as "antigen binding fragment"). This case is effective, for example, for elevating stability or antibody production efficiency.

The anti-FSTL1 antibody according to one embodiment of the present invention may be a fusion protein. This fusion protein may be the anti-FSTL1 antibody N- or C-terminally bound with a polypeptide or an oligopeptide. In this context, the oligopeptide may be a His tag. The fusion protein may also be the anti-FSTL1 antibody fused with a partial sequence of a mouse, human, or chicken antibody. Such fusion proteins are also included in one form of the anti-FSTL1 antibody according to the present embodiment.

The anti-FSTL1 antibody according to one embodiment of the present invention may be an antibody obtained through, for example, the step of immunizing an organism with purified FSTL1, FSTL1-expressing cells, or a FSTL1-containing lipid membrane. It is preferred to use FSTL1-expressing cells in the immunization, from the viewpoint of enhancing therapeutic effects on FSTL1-positive malignant tumor.

The anti-FSTL1 antibody according to one embodiment of the present invention may be an antibody having the CDR set of the antibody obtained through the step of immunizing an organism with purified FSTL1, FSTL1-expressing cells, or a FSTL1-containing lipid membrane. It is preferred to use FSTL1-expressing cells in the immunization, from the viewpoint of enhancing therapeutic effects on FSTL1-positive malignant tumor. The CDR set is a set of heavy chain CDR1, CDR2, and CDR3 and light chain CDR1, CDR2, and CDR3.

In one embodiment of the present invention, "FSTL1-expressing cells" may be obtained, for example, by transfecting cells with a polynucleotide encoding FSTL1, followed by the expression of FSTL1. In this context, the FSTL1 includes a FSTL1 fragment. In one embodiment of the present invention, "FSTL1-containing lipid membrane" may be obtained, for example, by mixing FSTL1 with a lipid bilayer. In this context, the FSTL1 includes a FSTL1 fragment. The anti-FSTL1 antibody according to one embodiment of the present invention is preferably an antibody obtained through the step of immunizing a chicken with the antigen, or an antibody having the CDR set of the antibody, from the viewpoint of enhancing therapeutic effects on FSTL1-positive malignant tumor.

The anti-FSTL1 antibody according to one embodiment of the present invention may have any avidity as long as the purpose is attained. Examples thereof can include, but are not limited to, a KD value (kd/ka) of at least $1.0\times10^6$ (M) or less, $2.0\times10^6$ (M) or less, $5.0\times10^6$ (M) or less, and $1.0\times10^{-7}$ or less. Usually, the KD value (kd/ka) may be $1.0\times10^{-7}$ (M) or less and can be $1.0\times10^{-9}$ (M) or $1.0\times10^{-10}$ (M) or less.

The anti-FSTL1 antibody according to one embodiment of the present invention may have ADCC or CDC activity.

The anti-FSTL1 antibody according to one embodiment of the present invention may be an antibody binding to wild-type or mutant-type FSTL1. The mutant type includes a form attributed to the difference in DNA sequence among individuals. The amino acid sequence of the wild-type or mutant-type FSTL1 has preferably 80% or higher, more preferably 90% or higher, more preferably 95% or higher, particularly preferably 98% or higher homology to the amino acid sequence represented by SEQ ID NO: 2 or SEQ ID NO: 4.

In one embodiment of the present invention, "antibody" includes a molecule that can specifically bind to a particular epitope on an antigen, or a population thereof. Also, the antibody may be a polyclonal antibody or a monoclonal antibody. The antibody can be present in various forms and may be in one or more forms selected from the group consisting of, for example, a full-length antibody (antibody having Fab and Fc regions), a Fv antibody, a Fab antibody, a F(ab')2 antibody, a Fab' antibody, diabody, a single-chain antibody (e.g., scFv), dsFv, a multispecific antibody (e.g., a bispecific antibody), a peptide or polypeptide having antigen binding activity, a chimeric antibody (e.g., a mouse-human chimeric antibody and a chicken-human chimeric antibody), a mouse antibody, a chicken antibody, a humanized antibody, a human antibody, and their equivalents. The antibody also includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach. Such an antibody may be further covalently bound with or recombinantly fused with an enzyme, for example, alkaline phosphatase, horseradish peroxidase, or a galactosidase. The anti-FSTL1 antibody used in the present invention is not limited by its origin, type, shape, etc. as long as the antibody binds to the FSTL1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "polyclonal antibody" can be produced, for example, by administering an immunogen comprising the intended antigen to a mammal (e.g., a rat, a mouse, a rabbit, cattle, and a monkey), bird, or the like in order to induce the production of an antigen-specific polyclonal antibody. The administration of the immunogen may be the injection of one or more immunizing agents and, if desired, an adjuvant. The adjuvant may also be used for increasing immune response and may include, for example, a Freund's adjuvant (complete or incomplete), a mineral gel (aluminum hydroxide, etc.), or a surfactant (lysolecithin, etc.). An immunization protocol is known in the art and may be carried out by an arbitrary method for inducing immune response according to a host organism to be selected (Tanpakushitsu Jikken Handobukku (Protein Experiment Handbook in English), Yodosha Co., Ltd. (2003): 86-91).

In one embodiment of the present invention, "monoclonal antibody" includes the case where individual antibodies constituting a population are antibodies each corresponding to a substantially single epitope except for antibodies having a small amount of a mutation that can occur naturally. Alternatively, the individual antibodies constituting a population may be substantially identical antibodies except for antibodies having a small amount of a mutation that can occur naturally. The monoclonal antibody is highly specific and differs from an ordinary polyclonal antibody which typically comprise different antibodies corresponding to different epitopes. In addition to the specificity, the monoclonal antibody is useful because the monoclonal antibody can be synthesized from hybridoma culture that is not contaminated with other immunoglobulins. The epithet "monoclonal" may indicate the feature of being obtained from a substantially homogeneous antibody population, but does not mean that the antibody must be produced by a certain method. For example, the monoclonal antibody may be prepared by a method similar to a hybridoma method as described in "Kohler G, Milstein C., Nature. 1975 Aug. 7; 256 (5517): 495-497". Alternatively, the monoclonal antibody may be prepared by a method similar to a recombination method as described in U.S. Pat. No. 4,816,567. Alternatively, the monoclonal antibody may be isolated from a phage antibody library by use of a method similar to a technique as described in "Clackson et al., Nature. 1991 Aug. 15; 352 (6336): 624-628" or "Marks et al., J Mol Biol. 1991 Dec. 5; 222 (3): 581-597". Alternatively, the monoclonal antibody may be prepared by a method described in "Tanpakushitsu Jikken Handobukku (Protein Experiment Handbook in English), Yodosha Co., Ltd. (2003): 92-96".

For the large-scale production of the antibody, an arbitrary approach known in the art can be used. Typical examples of the construction of a large-scale antibody production system and antibody production can include the following: CHO cells are transfected with a H chain antibody expression vector and a L chain antibody expression vector, cultured using a selection reagent G418 and Zeocin, and cloned by a limiting dilution method. After the cloning, a clone stably expressing the antibody is selected by ELISA. The selected CHO cell is used in extended culture to recover a culture supernatant containing the antibody. The antibody can be purified by protein A or protein G purification from the recovered culture supernatant.

In one embodiment of the present invention, "Fv antibody" is an antibody containing an antigen recognition site. This region comprises a dimer of one heavy chain variable domain and one light chain variable domain through non-covalent binding. In this configuration, the respective three CDRs of the variable domains can act mutually to form an antigen binding site on the surface of the VH-VL dimer.

In one embodiment of the present invention, "Fab antibody" is, for example, an antibody comprising the N-terminal half of the H chain and the whole L chain disulfide-bonded at a part of the antibody, among fragments obtained by treating an antibody comprising Fab and Fc regions with a proteolytic enzyme papain. Fab can be obtained, for example, by treating the anti-FSTL1 antibody according to the embodiments of the present invention comprising Fab and Fc regions with a proteolytic enzyme papain.

In one embodiment of the present invention, "F(ab')2 antibody" is, for example, an antibody containing two sites each corresponding to Fab, among fragments obtained by treating an antibody comprising Fab and Fc regions with a proteolytic enzyme pepsin. F(ab')2 can be obtained, for example, by treating the anti-FSTL1 antibody according to the embodiments of the present invention comprising Fab and Fc regions with a proteolytic enzyme pepsin. Also, F(ab')2 can be prepared, for example, by thioether-bonding or disulfide-bonding Fab' fragments described below.

In one embodiment of the present invention, "Fab' antibody" is, for example, an antibody obtained by cleaving the disulfide bond in the hinge region of F(ab')2. Fab' can be obtained, for example, by treating F(ab')2 with a reducing agent dithiothreitol.

In one embodiment of the present invention, "scFv antibody" is an antibody comprising VH and VL linked via an appropriate peptide linker. The scFv antibody can be produced, for example, by obtaining cDNAs encoding VH and VL of the anti-FSTL1 antibody according to the embodiments of the present invention, constructing a polynucleotide encoding VH-peptide linker-VL, and integrating the polynucleotide into a vector, followed by use of cells for expression.

In one embodiment of the present invention, "diabody" is an antibody having divalent antigen binding activity. The divalent antigen binding activity may be the same antigen binding activities or may be different antigen binding activities. The diabody can be produced, for example, by constructing polynucleotides encoding scFvs such that the length of the amino acid sequence of a peptide linker is 8 or less residues, and integrating the obtained polynucleotides into a vector, followed by use of cells for expression.

In one embodiment of the present invention, "dsFv" is an antibody obtained by bonding polypeptides containing cysteine residues introduced in VH and VL, via a disulfide bond between the cysteine residues. The positions to which the cysteine residues are introduced can be selected on the basis of the conformational prediction of the antibody according to a method shown by Reiter et al. (Reiter et al., Protein Eng. 1994 May; 7 (5): 697-704).

In one embodiment of the present invention, "peptide or polypeptide having antigen binding activity" is an antibody constituted to comprise the VH or VL of the antibody, or CDR1, CDR2, or CDR3 thereof. A plurality of CDR-containing peptides can be bonded directly or via an appropriate peptide linker.

A method for producing the Fv antibody, Fab antibody, F(ab')2 antibody, Fab' antibody, scFv antibody, diabody, dsFv antibody, or peptide or polypeptide having antigen binding activity (hereinafter, also referred to as "Fv antibody, etc.") described above is not particularly limited. For example, DNA encoding a region in the Fv antibody, etc. for the anti-FSTL1 antibody according to the embodiments of the present invention is integrated into a vector for expression, and the Fv antibody, etc. can be produced using cells for expression. Alternatively, the Fv antibody, etc. may be produced by a chemical synthesis method such as Fmoc method (fluorenylmethyloxycarbonyl method) or tBOC method (t-butyloxycarbonyl method). The antigen binding fragment according to one embodiment of the present invention may be one or more of the Fv antibody, etc.

In one embodiment of the present invention, "chimeric antibody" is, for example, an antibody comprising the variable regions of an antibody of an organism species linked to the constant regions of an antibody of an organism species different therefrom, and can be constructed by a gene recombination technique. A mouse-human chimeric antibody can be prepared by a method described in, for example, "Roguska et al., Proc Natl Acad Sci USA. 1994 Feb. 1; 91 (3): 969-973". In a basic method for preparing the mouse-human chimeric antibody, for example, mouse leader sequences and variable region sequences present in cloned cDNA are linked to human antibody constant region-encoding sequences already present in an expression vector for mammalian cells. Alternatively, mouse leader sequences and variable region sequences present in cloned cDNA may be linked to human antibody constant region-encoding sequences and then ligated with an expression vector for mammalian cells. Fragments of human antibody constant regions can be arbitrary H and L chain constant regions of a human antibody. Examples thereof can include Cyl, Cy2, Cy3, and Cy4 for human H chains and CX or CK for L chains.

In one embodiment of the present invention, "humanized antibody" is, for example, an antibody that has one or more CDRs derived from a non-human species and framework regions (FRs) derived from a human immunoglobulin, and further, human immunoglobulin-derived constant regions, and binds to a desired antigen. The antibody humanization can be carried out by use of various approaches known in the art (Almagro et al., Front Biosci. 2008 Jan. 1; 13: 1619-1633). Examples thereof include CDR grafting (Ozaki et al., Blood. 1999 Jun. 1; 93 (11): 3922-3930), re-surfacing (Roguska et al., Proc Natl Acad Sci USA. 1994 Feb. 1; 91 (3): 969-973), and FR shuffle (Damschroder et al., Mol Immunol. 2007 April; 44 (11): 3049-3060. Epub 2007 Jan. 22). In order to alter (preferably, improve) antigen binding, an amino acid residue in a human FR region may be substituted by a corresponding residue from a CDR donor antibody. This FR substitution can be carried out by a method well known in the art (Riechmann et al., Nature. 1988 Mar. 24; 332 (6162): 323-327). For example, a FR residue important for antigen binding may be identified by the interaction modeling of CDR and FR residues. Alternatively, an abnormal FR residue may be identified at a particular position by sequence comparison. In a preferred embodiment, the humanized antibody may be constructed on the basis of the report of Matsuda et al. Molecular Immunology 43 (2006) 634-642.

In a preferred embodiment of the present invention, a humanized antibody having the H chain FR1, FR2, FR3, and FR4 (SEQ ID NOs: 169, 171, 173, and 175, respectively) and L chain FR1, FR2, FR3, and FR4 (SEQ ID NOs: 185, 187, 189, and 191, respectively) of H(2)-L(1) can be used, though the humanized antibody of the present invention is not limited thereto. As for the full-length sequences of the humanized antibody, the full-length sequence of the H(1) heavy chain in this humanized antibody is represented by SEQ ID NOs: 192 and 193 (which represent nucleic acid and amino acid sequences, respectively) for IgG1 type and represented by SEQ ID NOs: 198 and 199 (which represent nucleic acid and amino acid sequences, respectively) for IgG4 type. The full-length sequence of the H(2) heavy chain is represented by SEQ ID NOs: 194 and 195 (which represent nucleic acid and amino acid sequences, respectively) for IgG1 type and represented by SEQ ID NOs: 200 and 201 (which represent nucleic acid and amino acid sequences, respectively) for IgG4 type. The full-length sequence of the H(3) heavy chain is represented by SEQ ID NOs: 196 and 197 (which represent nucleic acid and amino acid sequences, respectively) for IgG1 type and represented by SEQ ID NOs: 202 and 203 (which represent nucleic acid and amino acid sequences, respectively) for IgG4 type. The full-length sequence of the L(1) light chain is represented by SEQ ID NOs: 204 and 205 (which represent nucleic acid and amino acid sequences, respectively). The full-length sequence of the L(2) light chain is represented by SEQ ID NOs: 246 and 247 (which represent nucleic acid and amino acid sequences, respectively). The full-length sequence of the L(3) light chain is represented by SEQ ID NOs: 248 and 249 (which represent nucleic acid and amino acid sequences, respectively). Although not wishing to be bound by any theory, activity higher by an order of magnitude was observed in H(2)-L(1) than H(3)-L(1) (frameworks of H(3): SEQ ID NOs: 177, 179, 181, and 183, respectively) and H(1)-L(1) (frameworks of H(1): SEQ ID NOs: 161, 163, 165, and 167, respectively).

In one embodiment of the present invention, "human antibody" is, for example, an antibody in which a region comprising heavy chain variable and constant regions and light chain variable and constant regions constituting the antibody is derived from a gene encoding a human immunoglobulin. A typical preparation method includes a transgenic mouse method for human antibody preparation, a phage display method, or the like. In the transgenic mouse method for human antibody preparation, a human antibody having diverse antigen binding ability instead of a mouse antibody is produced by transferring a functional human Ig gene to a mouse in which endogenous Ig has been knocked down. A human monoclonal antibody can be obtained by a conventional hybridoma method by further immunizing this mouse. This preparation can be performed by a method described in, for example, "Lonberg et al., Int Rev Immunol. 1995; 13 (1): 65-93". The phage display method is typically a system that allows a fibrous phage such as M13 or T7, an *E. coli* virus, to express a foreign gene as a fusion protein at the N terminus of its coat protein (g3p, g10p, etc.) so as not to lose the infectivity of the phage. This preparation can be performed by a method described in, for example, "Vaughan et al., Nat Biotechnol. 1996 March; 14 (3): 309-314".

The antibody may be prepared by grafting the heavy chain CDRs or light chain CDRs of the anti-FSTL1 antibody according to the embodiments of the present invention to an arbitrary antibody according to CDR grafting (Ozaki et al., Blood. 1999 Jun. 1; 93 (11): 3922-3930). Alternatively, the antibody can be obtained by ligating DNAs encoding the heavy chain CDRs or light chain CDRs of the anti-FSTL1 antibody according to the embodiments of the present invention, and DNAs encoding the regions, except for heavy chain CDRs or light chain CDRs, of a publicly known antibody derived from a human or a non-human organism with a vector according to a method known in the art, followed by expression using publicly known cells. In this respect, in order to enhance the action efficiency of the anti-FSTL1 antibody on the target antigen, the regions except for heavy chain CDRs or light chain CDRs may be optimized by use of a method known in the art (e.g., a method of randomly mutating amino acid residues of antibodies and screening for an antibody having high reactivity, or a phage display method). Also, FR regions may be optimized by use of, for example, FR shuffle (Damschroder et al., Mol Immunol. 2007 April; 44 (11): 3049-3060, Epub 2007 Jan. 22) or a method for substituting vernier zone amino acid residues or packaging residues (Japanese Patent Laid-Open No. 2006-241026; and Foote et al., J Mol Biol. 1992 Mar. 20; 224 (2): 487-499).

In one embodiment of the present invention, "heavy chain" is typically a main constituent of a full-length antibody. The heavy chain is usually disulfide-bonded or non-covalently bonded to a light chain. The N-terminal domain of the heavy chain has a region called variable region (VH) whose amino acid sequence is not constant even among antibodies of the same species and the same class. In general, VH is known to largely contribute to specificity and affinity for an antigen. For example, "Reiter et al., J Mol Biol. 1999 Jul. 16; 290 (3): 685-98" states that a molecule of only VH was prepared and consequently bound to an antigen specifically and with high affinity. "Wolfson W, Chem Biol. 2006 December; 13 (12): 1243-1244" states that among camel antibodies, there exist antibodies lacking light chains and having only heavy chains.

In one embodiment of the present invention, "CDRs (complementarity determining regions)" are regions that come in actual contact with an antigen and form a binding site in the antibody. In general, CDRs are positioned on Fv (comprising a heavy chain variable region variable region (VH) and a light chain variable region (VL)) of the antibody. In general, CDRs include CDR1, CDR2, and CDR3 each consisting of approximately 5 to 30 amino acid residues. Particularly, heavy chain CDRs are known to contribute to the binding of the antibody to the antigen. Among CDRs, CDR3 is known to make the highest contribution to the binding of the antibody to the antigen. For example, "Willy et al., Biochemical and Biophysical Research Communications Volume 356, Issue 1, 27 Apr. 2007, Pages 124-128" states that the binding ability of an antibody was enhanced by altering heavy chain CDR3. Fv regions other than CDRs are called framework regions (FRs) which consist of FR1, FR2, FR3, and FR4, and are relatively well conserved among antibodies (Kabat et al., "Sequence of Proteins of Immunological Interest", US Dept. Health and Human Services, 1983). In short, a factor that characterizes the reactivity of the antibody is CDRs, particularly, heavy chain CDR.

There are a plurality of reports on the definition of CDRs and methods for determining the positions thereof. For example, the definition of Kabat (Sequences of Proteins of Immunological Interest, 5th ed., Public Health Service, National Institutes of Health, Bethesda, Md. (1991)) or the definition of Chothia (Chothia et al., J. Mol. Biol., 1987; 196: 901-917) may be adopted. In one embodiment of the present invention, the definition of Kabat is adopted as a suitable example, though the definition of CDRs is not necessarily limited thereto. In some cases, CDRs may be determined in consideration of both the definition of Kabat and the definition of Chothia. For example, overlapping moieties of CDRs according to the respective definitions or moieties including both CDRs of the respective definitions may be used as CDRs. Specific examples of such a method include the method of Martin et al. using Oxford Molecular's AbM antibody modeling software (Proc. Natl. Acad. Sci. USA, 1989; 86: 9268-9272), which is a combined method of the definition of Kabat and the definition of Chothia. A mutant that may be used in the present invention can be produced using such information on CDRs. Such an antibody mutant can be produced such that the substitution, addition, or deletion of 1 or several (e.g., 2, 3, 4, 5, 6, 7, 8, 9, and 10) amino acids is contained in a framework of the original antibody whereas no mutation is contained in the CDRs.

In the present specification, "antigen" refers to an arbitrary substrate to which an antibody molecule is capable of specifically binding. In the present specification, "immunogen" refers to an antigen capable of initiating lymphocyte activation resulting in antigen-specific immune response. In the present specification, "epitope" or "antigen determinant" refers to a site in an antigen molecule to which an antibody or a lymphocyte receptor binds. A method for determining the epitope is well known in the art. Those skilled in the art can determine such an epitope by use of such a well-known technique conventionally used, provided that the primary sequence of a nucleic acid or an amino acid is provided. It is understood that an antibody having a sequence different from that of the antibody of the present invention can be similarly used as long as the epitope for the antibody is the same as that for the antibody of the present invention.

It is understood that an antibody having any specificity may be used as the antibody used herein as long as false positivity is decreased. Thus, the antibody used in the present invention may be a polyclonal antibody or may be a monoclonal antibody.

In the present specification, "means" refers to a unit that can serve as an arbitrary tool to achieve a certain purpose (e.g., detection, diagnosis, and treatment). In the present specification, particularly, "selectively recognizing means" refers to means that can recognize a certain subject distinctively from others.

"Malignant tumor" used herein includes, for example, tumor that is developed by the mutation of normal cells. The malignant tumor may be developed from every organ or tissue throughout the body. The malignant tumor is used herein interchangeably with "cancer" unless otherwise specified. This malignant tumor includes one or more selected from the group consisting of, for example, lung cancer, esophageal cancer, stomach cancer, liver cancer, pancreatic cancer, kidney cancer, adrenal cancer, bile duct cancer, breast cancer, colorectal cancer, small intestine cancer, ovary cancer, uterine cancer, bladder cancer, prostate cancer, ureter cancer, renal pelvis cancer, ureter cancer, penis cancer, testis cancer, brain tumor, cancer of the central nervous system, cancer of the peripheral nervous system, head and neck cancer, glioma, glioblastoma multiforme, skin cancer, melanoma, thyroid gland cancer, salivary gland cancer, malignant lymphoma, carcinoma, sarcoma, leukemia, and malignant blood tumor. In this context, the ovary cancer includes, for example, ovarian serous adenocarcinoma or ovarian clear cell adenocarcinoma. The uterine cancer includes, for example, endometrial cancer or uterine cervical cancer. The head and neck cancer includes, for example, mouth cancer, throat cancer, larynx cancer, nasal cavity cancer, sinus cancer, salivary gland cancer, or thyroid gland cancer. The lung cancer includes, for example, non-small cell lung cancer or small-cell lung cancer. The malignant tumor may be FSTL1-positive.

In the present specification, "metastasis" refers to the process in which cancer spreads or travels from a primary focus to other regions of the body to develop a similar cancerous lesion at a new site. "Metastatic" or "metastasizing" cell is a cell that loses adhesive contact with adjacent cells and travels from a primary focus of the disease through blood flow or lymph to invade a neighboring structure of the body. In the present specification, the term "metastasis" preferably includes, but is not limited to, metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the metastasis of the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, "bone metastasis" means metastasis of cancer to bone and includes bone metastasis of an arbitrary origin. The term "bone metastasis" preferably includes, but is not limited to, bone metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the term "bone metastasis" also preferably includes a bone lesion, preferably an osteolytic and/or osteogenic bone lesion, more preferably an osteolytic bone lesion, still more preferably a bone lesion of myeloma, malignant myeloma, and/or multiple myeloma, particularly an osteolytic bone lesion of myeloma, malignant myeloma, and/or multiple myeloma. According to the present invention, the term "bone metastasis" also preferably includes a bone lesion of Waldenstrom's disease, preferably an osteolytic and/or osteogenic bone lesion of Waldenstrom's disease, more preferably an osteolytic bone lesion of Waldenstrom's disease. The bone metastasis according to the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, the term "mesenchymal stem cells" and its abbreviation "MSCs" can be used interchangeably. This term refers to pluripotent stem cells that have the ability to self-renew and possess the ability to differentiate into mesenchymal cells such as osteoblasts, chondrocytes, and adipocytes, and typically means, in a broad sense, a population of stem cells that grow in an undifferentiated state and are capable of differentiating into all or some of osteoblasts, chondroblasts, and lipoblasts, or progenitor cells thereof. In organisms, the mesenchymal stem cells are present with low frequency in bone marrow, peripheral blood, cord blood, fat tissues, and the like. The mesenchymal stem cells can be isolated or purified from these tissues by a publicly known method, and its main molecular index is CD45 expression negativity. "Isolation" or "purification" means the operation of artificially placing an intended component in a state different from a naturally occurring state, for example, the operation of removing components other than the intended component from a naturally occurring state. For example, human mesenchymal stem cells can be isolated from bone marrow fluid by a Percoll gradient method (Hum. Cell, vol. 10, p. 45-50, 1997). Alternatively, the human mesenchymal stem cells can be isolated by the culture and subculture of hematopoietic stem cells or the like after bone marrow puncture (Journal of Autoimmunity, 30 (2008) 163-171).

Mesenchymal stem cells induce or enhance immune defect such as immunosuppression or immunodeficiency. Activation is essential for acquiring this activity. MSCs increasing in number in association with cancer are considered to be "activated MSCs" after activation by various in vivo agents. In the present specification, such MSCs are also referred to as "activated mesenchymal stem cells" or "activated MSCs". Specifically, there exists the mechanism of immune defect, including, for example, the case where cells originally having immunosuppressive activity (e.g., regulatory T cells, tolerogenic dendritic cells, regulatory dendritic cells, and myeloid-derived suppressor cells) grow so that immunosuppressive activity is comprehensively strengthened, the case where cells normally having no activity (i.e., progenitor cells) acquire immunosuppressive properties to increase the rate of conversion to their cells having immunosuppressive activity (e.g., regulatory T cells, tolerogenic dendritic cells, regulatory dendritic cells, and myeloid-derived suppressor cells) so that immunosuppressive activity is strengthened, and induction of exhausted T cells that fall into an immunocompromised status that fails to exert immune functions. FSTL1 is considered to control the mechanism directly and/or indirectly via the growth of activated MSCs, etc. (Immunology and Cell Biology 91: 12-18, 2013). Although not wishing to be bound by any theory, the antibody FSTL1 antibody, etc. of the present invention can inhibit the induction or enhancement of immunosuppression by these MSCs, and immunodeficiency, etc. and can thereby mitigate immunosuppression responsible for the aggravation of cancer. Hence, remarkable prophylactic or therapeutic effects on cancer can be achieved. As for the induction or enhancement of MSCs inducing these cells for immune defect such as immunosuppressive cells and/or immunodeficient cells, it is considered that the present invention can inhibit an upstream region thereof and can therefore mitigate the whole mechanism of immune defect such as immunosuppression and/or immunodeficiency. Thus, more effective treatment is probably achieved.

Figure 9:
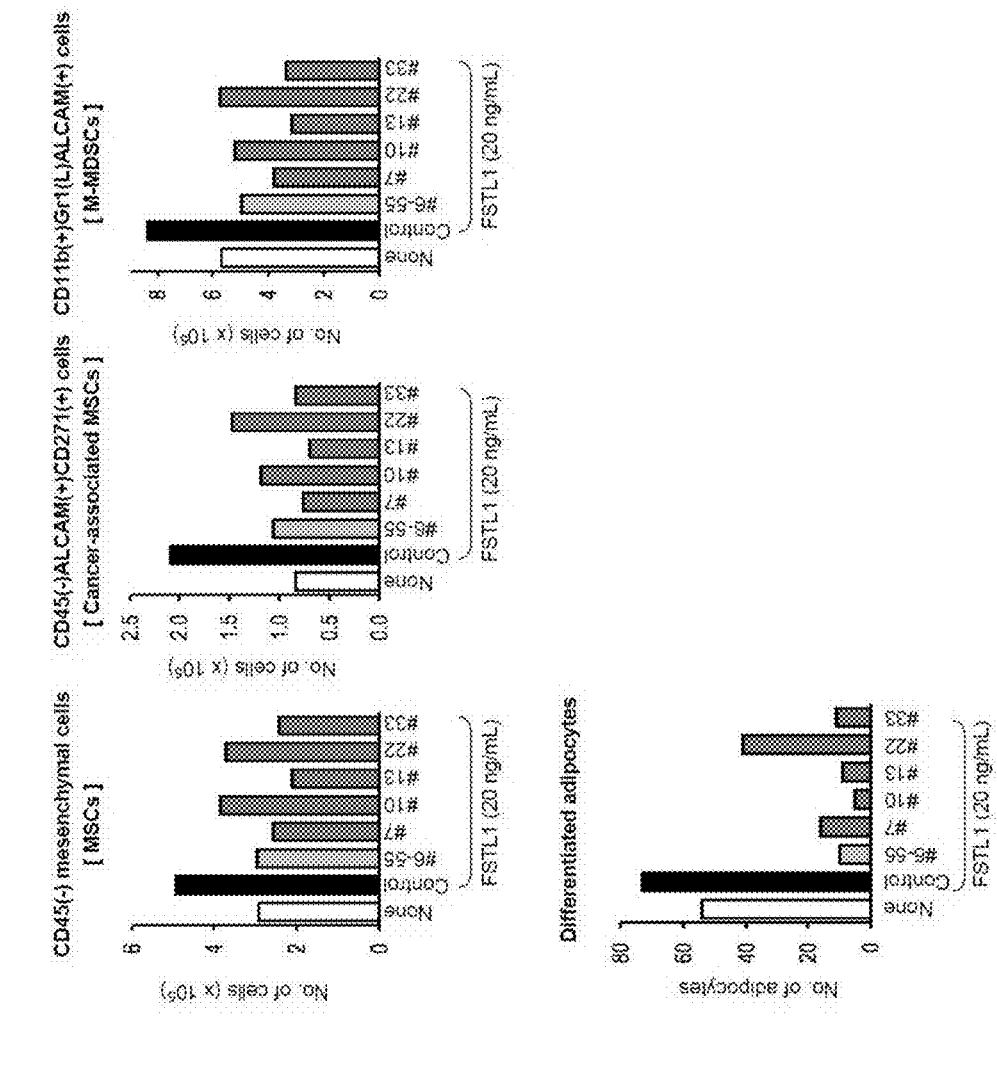
FIG. 9 Part A of FIG. 9 shows results of conducting the same test as that of FIG. 8 using other clones (clones described in each graph) (Example 14). As in FIG. 8, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody (anti-DNP antibody) is depicted shown in the second bar from the left, the anti-PD-L1 antibody is depicted in the rightmost bar, and intermediate 4 clones respectively represent the anti-FSTL1 antibodies. As a result, all of the clones exhibited inhibitory activity against the induction of MSCs, cancer-associated MSCs, and MDSCs by FSTL1, as compared with the control antibody. Among them, #13 and #33 exhibited inhibitory activity equivalent to or higher than that of the positive control (#6-55). These results seem to be reasonable because epitopes for #13 and #6-55 are the same regions. Part B shows results of analyzing inhibitory activity against the induction of MSCs having the ability to differentiate into adipocytes. In the graph, none is depicted in the leftmost bar, and a control is depicted in the second bar from the left followed by anti-FSTL1 antibody clones. All of the anti-FSTL1 antibody clones exhibited inhibitory activity against the differentiation induction of MSCs having the ability to differentiate into adipocytes by FSTL1.
Figure 10:
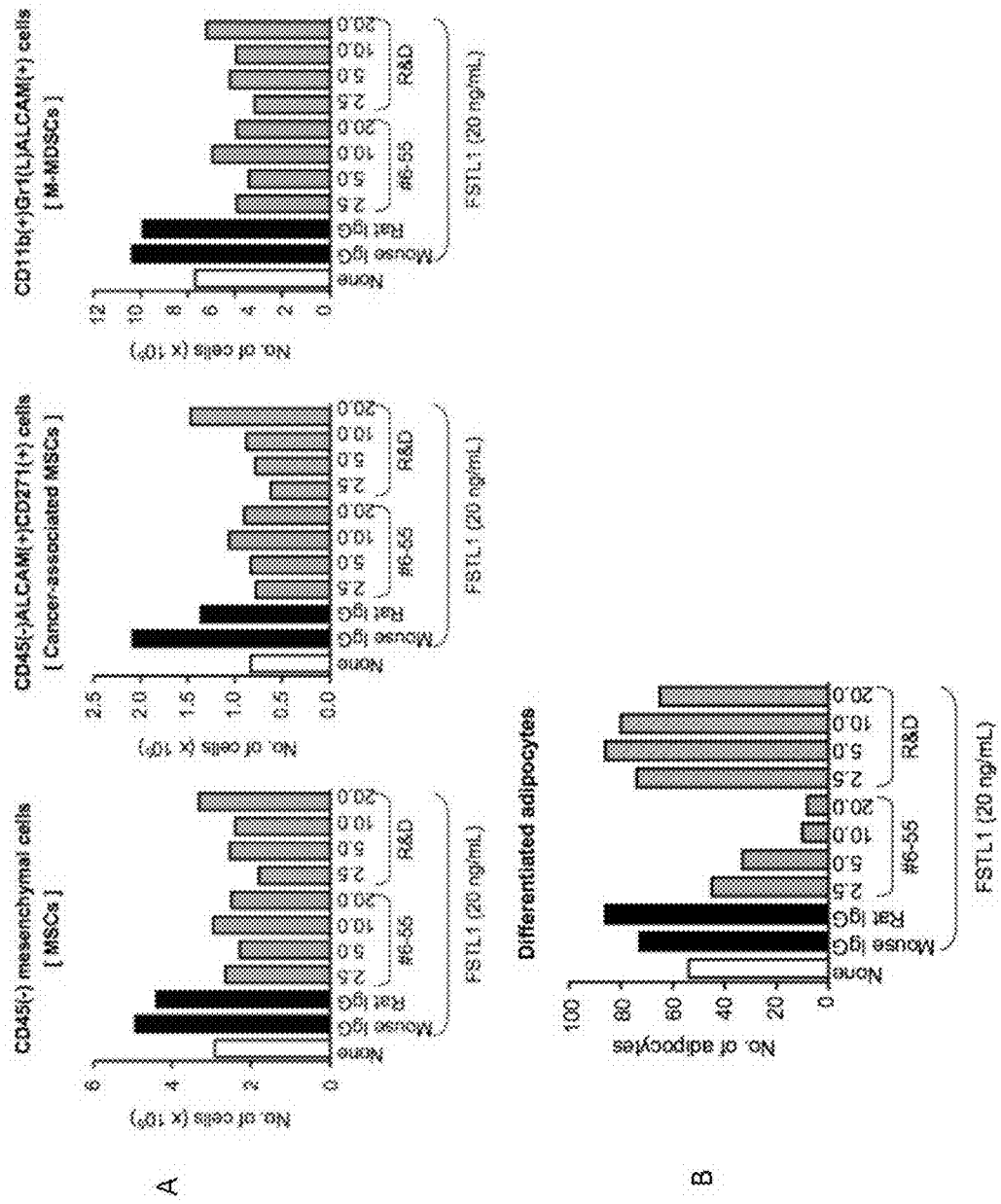
FIG. 10 shows activity comparison with an anti-FSTL1 antibody manufactured by R&D Systems, Inc. evaluated in Examples of Patent Literature 1 (WO2009/028411) (Examples 15 and 16). Part A shows results of conducting a dose dependence test in order to compare #6-55 (mouse chimeric antibody) with the anti-FSTL1 antibody manufactured by R&D Systems, Inc. (rat antibody; indicated by R&D), and analyzing inhibitory activity against the action of FSTL1 in the same way as in FIG. 8 (Example 15). In part A, as in FIG. 8, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The antibody manufactured by R&D Systems, Inc. exhibited inhibitory activity against the induction of each cell by FSTL1 at the same level as in #6-55. No dose-dependent effect was confirmed. When the antibody of each isotype is used as a reference, the inhibitory activity of #6-55 is considered to be slightly superior. Part B shows results of analyzing inhibitory activity against the induction of MSCs having the ability to differentiate into adipocytes (Example 16). In the graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The induction of MSCs having the ability to differentiate into adipocytes was inhibited by #6-55 in an antibody dose-dependent manner. On the other hand, the antibody manufactured by R&D Systems, Inc. exhibited no inhibitory activity, demonstrating the superiority of the antibody of #6-55. The ability to differentiate into adipocytes is one of the functions of cancer-associated MSCs (cells also shown in the middle graph of part A) inducing immunosuppression. From the comparison of part A with part B, it can be concluded that: when the rat control antibody, i.e., a "rat-derived protein", was administered into the living bodies of mice, its own response was reduced, as compared with the case of administering the mouse control antibody (mouse-derived protein) (particularly, the middle graph of part A). This is presumably because immune response to foreign matter occurred slightly because mouse bone marrow cells were used. In the case of administering the FSTL1 antibody of R&D Systems, Inc., which is also a "rat-derived protein", comparison with this rat control antibody administration group was supposed to be reasonable. Nonetheless, in light of the "rate of suppression" with respect to each control protein, the rate of suppression of the FSTL1 antibody of R&D Systems, Inc. with respect to the rat control antibody administration group was smaller than the rate of suppression of 6-55 with respect to the mouse control antibody administration group, suggesting that #6-55 is superior as a matter of fact. Not all of CD45-negative MSCs induced by FSTL1 are cancer-associated MSCs which cause immunosuppression, and such cancer-associated MSCs need to be identified using several types of markers, the ability to differentiate into adipocytes, etc. It can be concluded that the antibody of the present invention can strongly inhibit the induction of cancer-associated MSCs by inhibiting the action of FSTL1.

The suppression of induction or growth of mesenchymal stem cells (MSCs) (including cancer-associated MSCs and activated MSCs) can be confirmed, for example, by examining the inhibition of differentiation of MSCs into adipocytes, for example, as shown in FIGS. 9 and 10. Although not wishing to be bound by any theory, FSTL1 is considered to increase the number of immunosuppressive MSCs themselves and/or to strengthen suppressive activity against other cells.

In the present specification, "enhancement" of "immunosuppression" (the term "immunosuppression" is also referred to as immunosuppressive properties, immunoregulation, immunoregulatory properties, immunomodulation, immunomodulatory properties, immunomodification, and immunomodifying properties, and these terms are used interchangeably in the art) conceptually encompasses enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells) and refers to consequent enhancement of immunosuppression. Thus, it is understood that the enhancement of immunosuppression conceptually includes enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells). The manner of induction of immunosuppressive cells by MSC cells encompasses promotion of differentiation into immunosuppressive cells such as regulatory T cells, enhancement of the immunosuppressive activity of immunosuppressive cells such as regulatory T cells, and growth of immunosuppressive cells such as regulatory T cells, and encompasses consequent enhancement of immunosuppressive properties.

In the present specification, "immunosuppressive cells" (the term "immunosuppressive" is also referred to as immunoregulatory, immunomodulatory, and immunomodifying, and these terms are used interchangeably in the art) refer to cells having a function of suppressing immune competence. Typical examples thereof can include, but are not limited to, regulatory T cells, regulatory dendritic cells, tolerogenic dendritic cells, and myeloid-derived suppressor cells.

It is known that not only immunosuppression as described above but immunodeficiency plays a role in the mechanism underlying the disruption of immune functions by mesenchymal stem cells (MSCs). The immunosuppression and the immunodeficiency are collectively referred to as "immune defect".

In the present specification, "immunodeficiency" refers to a state in which the normal immune mechanism has been damaged due to a lack or dysfunction of a portion or some of cellular elements constituting the immune system. Pathological conditions caused thereby are collectively referred to as immunodeficiency diseases. The immunodeficiency diseases are broadly divided into primary and secondary diseases. The former is mainly ascribable to congenital genetic abnormality, and the latter refers to diseases caused by physicochemical factors such as drugs or X-ray or external environmental factors such as viral infection or nutritional status. The damaged site is reportedly attributed to various causes such as dysfunction of a B cell zone such as antibody production, abnormality in T cell zone involved in cellular immunity, and impaired functions of cells of the complement system or the phagocytic system (e.g., a phagocytic function). "Exhausted T cells" serve as a main index for immunodeficiency. The anti-PD-1 antibody, etc. is also developed as an antibody that can inhibit this "exhaustion/incompetence".

In the present specification, "immune defect" conceptually refers to immunosuppression and immunodeficiency in combination. When the immune defect occurs, low immunogenic cancer cells more advantageous for survival grow selectively (an equilibrium phase (state in which cancer cells neither disappear nor grow through their interaction with immunocytes) is shifted to an escape phase). It is considered that the immunogenicity of cancer is reduced in a short time from the end of the equilibrium phase through the escape phase. T cells supposed to kill cancer cells reportedly play this role paradoxically.

In the present specification, "exhaustion" means that various co-suppressive molecules such as PD-1, CTLA4, and TIM3 (mentioned later) are induced on T cells due to long-term exposure to an antigen so that the T cells fall into a dysfunctional state. This is considered to be responsible for inducing the irresponsiveness of T cells in chronic infection or cancer. In the present specification, such T cells are referred to as "exhausted T cells".

The anti-PD-1 antibody, etc. is also developed as an antibody that can inhibit this "exhausted" state and "immunodeficiency". Thus, the anti-FSTL1 antibody used in the present invention can inhibit (growth or development of) exhausted T cells as shown in Examples, and is therefore expected to be able to inhibit such "exhausted" state and "immunodeficiency". Thus, it is understood that "immune defect" can be inhibited.

In the present specification, "immune-related cells" refer to arbitrary cells of the immune system that undergo immunosuppression, dysfunction, etc. In the present specification, it is understood that "acquirement and/or enhancement of immunosuppressive activity by or of immune-related cells" typically include, for example, growth of regulatory T cells, differentiation into regulatory T cells, growth of regulatory dendritic cells, differentiation into regulatory dendritic cells, growth of tolerogenic dendritic cells, differentiation into tolerogenic dendritic cells, growth of myeloid-derived suppressor cells, differentiation into myeloid-derived suppressor cells, and expansion of exhausted T cells.

In the present specification, "test subject" refers to a subject to be diagnosed, detected, or treated, for example, according to the present invention (e.g., an organism such as a human, or cells, blood, serum, etc. separated from the organism).

In the present specification, "sample" refers to an arbitrary substance obtained from a test subject or the like and includes, for example, serum. Those skilled in the art can appropriately select a preferred sample on the basis of the description of the present specification.

In the present specification, "agent" is used in a broad sense and may be any substance or other factor (e.g., energy such as light, radioactivity, heat, or electricity) as long as the intended purpose can be attained. Examples of such a substance include, but are not limited to, proteins, polypeptides, oligopeptides, peptides, polynucleotides, oligonucleotides, nucleotides, nucleic acids (including e.g., DNA such as cDNA and genomic DNA, and RNA such as mRNA), polysaccharides, oligosaccharides, lipids, organic small molecules (e.g., hormones, ligands, signaling substances, organic small molecules, molecules synthesized by combinatorial chemistry, and pharmaceutically available small molecules (e.g., low-molecular ligands)), and complex molecules thereof. Typical examples of the agent specific for a polynucleotide include, but are not limited to, a polynucleotide having complementarity with given sequence homology (e.g., 70% or higher sequence identity) to the sequence of the polynucleotide, and a polypeptide such as a transcriptional factor binding to a promoter region. Typical examples of the agent specific for a polypeptide include, but are not limited to, an antibody specifically directed to the polypeptide, or a derivative thereof, or an analog thereof (e.g., a single-chain antibody), a specific ligand or receptor when the polypeptide is a receptor or a ligand, and a substrate when the polypeptide is an enzyme.

In the present specification, "diagnosis" means that various parameters associated with a disease, a disorder, a condition (e.g., malignant tumor), or the like in a test subject are identified to determine the current status or future of such a disease, disorder, or condition. The state within the body can be examined by use of the method, the apparatus, or the system of the present invention. Various parameters such as the disease, disorder, or condition in the test subject, a procedure to be administered, or a formulation or a method for prevention can be selected using such information. In the present specification, "diagnosis" refers to the diagnosis of the current status in a narrow sense and includes "early diagnosis", "predictive diagnostics", "pre-diagnosis", and the like in a broad sense. The diagnosis method of the present invention is industrially useful because the method can utilize materials separated from the body, as a rule, and can be carried out with no help from healthcare professionals such as physicians. In the present specification, particularly, "predictive diagnostics, pre-diagnosis, or diagnosis" is also referred to as "support" in order to clarify feasibility with no help from healthcare professionals such as physicians.

In the present specification, the term "prognosis" means prediction of the possibility of death or progression attributed to cancer, such as recurrence, metastatic spread, and drug resistance of a neoplastic disease such as malignant tumor (e.g., ovary cancer). Thus, in the present specification, "good prognosis" means that recurrent cancer originating from the primary cancer is absent beyond a given period (e.g., 4 years) after cancer tissue resection. "Poor prognosis" means that recurrent cancer originating from the primary cancer is present beyond a given period (e.g., 4 years) after cancer tissue resection. A prognosis factor is a variable regarding the natural course of malignant tumor and influences the rate of recurrence and outcome of a patient that has suffered from malignant tumor. A clinical index related to the worsening of prognosis includes, for example, lymph node metastasis and high-grade tumor. The prognosis factor is often used for classifying patients into subgroups having different basic risks of recurrence. Accordingly, the expression of the FSTL1 of the present invention can be used as a prognosis factor. In the present specification, the term "prediction" means the possibility that a patient has a particular clinical outcome, regardless of whether to be good or poor, after removal of primary tumor. Thus, the FSTL1 of the present invention can be used as a marker for poor prognosis. A treatment method can be determined by selecting a treatment method optimal for a particular patient by clinical use of the prediction method of the present invention. The prediction method of the present invention is beneficial means for prediction provided that there is the possibility that a patient has good response to a treatment regimen, for example, surgical intervention. The prediction can involve a prognosis factor.

In the present specification, "detecting drug (agent)" or "testing drug (agent)" refers to every agent that permits detection or test of a targeted subject in a broad sense.

In the present specification, "diagnostic drug (agent)" refers to every agent that permits diagnosis of a targeted condition (e.g., a disease such as malignant tumor) in a broad sense.

In the present specification, "treatment" of a certain disease or disorder (e.g., malignant tumor) refers to the prevention of aggravation of such a disease or disorder, preferably status quo, more preferably alleviation, further preferably resolution, of such a disease or disorder, after occurrence of such a condition. The treatment includes capability of exerting a symptom-ameliorating effects or prophylactic effects on a disease in a patient or one or more symptoms associated with the disease. Appropriate treatment based on pre-diagnosis is referred to as "companion treatment". A diagnostic drug therefor is also referred to as "companion diagnostic drug".

In the present specification, "therapeutic drug (agent)" refers to every agent that permits treatment of a targeted condition (e.g., a disease such as malignant tumor) in a broad sense. In one embodiment of the present invention, "therapeutic drug" may be a pharmaceutical composition comprising an active ingredient and one or more pharmacologically acceptable carriers. The pharmaceutical composition can be produced, for example, by mixing the active ingredient with the carriers and performing an arbitrary method known in the pharmaceutical technical field. The therapeutic drug is not limited by the type of usage as long as the therapeutic drug is used for treatment. The therapeutic drug may be the active ingredient alone or may be a mixture of the active ingredient and an arbitrary ingredient. The carriers are not particularly limited by their forms and may be, for example, solids or liquids (e.g., buffer solutions). The therapeutic drug for malignant tumor includes a drug for use in the prevention of malignant tumor (prophylactic drug) or a growth suppressor of malignant tumor cells.

In the present specification, "prevention" of a certain disease or disorder (e.g., malignant tumor) refers to protection against occurrence of such a condition before occurrence of this condition. Diagnosis is conducted using the agent of the present invention, and the prevention of, for example, malignant tumor, or measures for the prevention can be carried out using the agent of the present invention according to the need.

In the present specification, "prophylactic drug (agent)" refers to every agent that permits prevention of a targeted condition (e.g., a disease such as malignant tumor) in a broad sense.

In the present specification, "interaction" when two substances are mentioned means that force (e.g., intermolecular force (van der Waals attraction), a hydrogen bond, and hydrophobic interaction) works between one of the substances and the other substance. Usually, two substances that have interacted with each other are in an associated or bound state. The detection, the testing, and the diagnosis of the present invention can be achieved through the use of such interaction.

The term "binding" used herein means the physical interaction or chemical interaction between two substances or between their combinations. The binding includes an ionic bond, a non-ionic bond, a hydrogen bond, van der Waals binding, hydrophobic interaction, and the like. The physical interaction (binding) can be direct or indirect. The indirect binding is mediated by or attributed to the effects of another protein or compound. The direct binding refers to interaction that is neither mediated by nor attributed to the effects of another protein or compound and involves no other substantial chemical intermediates.

Thus, in the present specification, "agent" (or a detecting agent, etc.) "specifically" interacting with (or binding to) a biological agent such as a polynucleotide or a polypeptide encompasses an agent whose affinity for the biological agent such as the polynucleotide or the polypeptide is typically equivalent to or higher, preferably significantly (e.g., statistically significantly) higher, than its affinity for other unrelated polynucleotides or polypeptides (particularly, having less than 30% identity). Such affinity can be measured by, for example, hybridization assay or binding assay.

In the present specification, the phrase "first substance or agent "specifically" interacts with (or binds to) a second substance or agent" means that the first substance or agent interacts with (or binds to) the second substance or agent with higher affinity than that for substances or agents other than the second substance or agent (particularly, other substances or agents present in a sample containing the second substance or agent). Examples of the specific interaction (or binding) between substances or agents include, but are not limited to: the reactions between nucleic acids or proteins, such as hybridization for the nucleic acids, and antigen-antibody reaction and enzyme-substrate reaction for the proteins; and protein-lipid interaction and nucleic acid-lipid interaction. Thus, in the case where both of the substances or agents are nucleic acids, the "specific interaction" of the first substance or agent with the second substance or agent encompasses the case where the first substance or agent has complementarity to at least a portion of the second substance or agent. Alternatively, in the case where both of the substances or agents are proteins, examples of the "specific" interaction (or binding) of the first substance or agent with (or to) the second substance or agent include, but are not limited to, interaction through antigen-antibody reaction, interaction through receptor-ligand reaction, and enzyme-substrate interaction. In the case where two types of substances or agents comprise proteins and nucleic acids, the "specific" interaction (or binding) of the first substance or agent with (or to) the second substance or agent encompasses the interaction (or binding) between an antibody and its antigen. An analyte in a sample can be detected or quantified through the use of the reaction of such specific interaction or binding.

In the present specification, "detection" or "quantification" of polynucleotide or polypeptide expression can be achieved by use of an appropriate method including, for example, mRNA assay and immunological assay methods involving binding to or interaction with a detecting agent, a testing agent, or a diagnostic agent. Examples of the molecular biological assay method include Northern blot, dot blot, and PCR. Examples of the immunological assay method include methods such as ELISA using microtiter plates, RIA, fluorescence immunoassay, luminescence immunoassay (LIA), immunoprecipitation (IP), single radial immunodiffusion (SRID), turbidimetric immunoassay (TIA), Western blot, and immunohistological staining. Examples of the quantification method include ELISA and RIA. The detection or the quantification may be performed by a gene analysis method using an array (e.g., a DNA array and a protein array). The DNA array is broadly reviewed in (Gakken Medical Shujunsha Co., Ltd. ed., Cell Engineering, Suppl., "DNA microarray and latest PCR methods"). The protein array is described in detail in Nat Genet. 2002 December; 32 Suppl: 526-532. Examples of the gene expression analysis method include, but are not limited to, RT-PCR, RACE, SSCP, immunoprecipitation, two-hybrid systems, and in vitro translation, in addition to those mentioned above. Such an additional analysis method is described in, for example, Genomu Kaiseki Jikken Ho (Experimental Methods for Genomic Analysis in English), Nakamura Lab Manual, Yusuke Nakamura, ed., Yodosha Co., Ltd. (2002), the description of which is incorporated herein by reference in its entirety.

In the present specification, "expression level" refers to the amount of a polypeptide or mRNA, etc. expressed in intended cells, tissues, or the like. Examples of such an expression level include the expression level at the protein level of the polypeptide of the present invention evaluated by any appropriate method including an immunological assay method such as ELISA, RIA, fluorescence immunoassay, Western blot, or immunohistological staining using the antibody of the present invention, and the expression level at the mRNA level of the polypeptide of the present invention evaluated by any appropriate method including a molecular biological assay method such as Northern blot, dot blot, or PCR. "Change in expression level" means increase or decrease in the expression level at the protein or mRNA level of the polypeptide of the present invention evaluated by any appropriate method including the immunological assay method or molecular biological assay method described above. The expression level of a certain marker can be measured to thereby variously conduct detection or diagnosis based on the marker.

In the present specification, "decrease" or "suppression", or its synonym of activity or an expression product (e.g., a protein and a transcript (RNA, etc.)) refers to decrease in the amount, quality, or effect of the particular activity, transcript, or protein, or decreasing activity thereagainst. In the case where the decrease results in "disappearance", the decrease means that the activity, the expression product, etc. becomes less than the detection limit, and is also particularly referred to as "disappearance". In the present specification, "disappearance" is encompassed by "decrease" or "suppression".

In the present specification, "increase" or "activation", or its synonym of activity or an expression product (e.g., a protein and a transcript (RNA, etc.)) refers to increase in the amount, quality, or effect of the particular activity, transcript, or protein, or increasing activity thereagainst.

In the present specification, "in vivo" refers to the inside of a living body. In a particular context, "in vivo" refers to a position at which an intended substance should be located.

In the present specification, "in vitro" refers to a state in which a portion of a living body is extracted or liberated to the "outside of the living body" (e.g., into a test tube) for various studies. This term makes a contrast with the term "in vivo".

In the present specification, "ex vivo" refers to a series of operations when a certain procedure is performed outside the body and the resultant is intended to be then brought back to the body. In the present invention as well, an embodiment is possible in which cells present in a living body are treated with the agent of the present invention and then brought back to the patient.

In the present specification, "kit" usually refers to a unit by which parts to be provided (e.g., a testing drug, a diagnostic drug, a therapeutic drug, an antibody, a label, and a written explanation) are provided in two or more divided compartments. This kit form is preferred when the parts should not be provided as a mixture for stability or the like and are intended to be mixed immediately before use to provide a preferred composition. For such a kit, it is advantageous to comprise, preferably, an instruction manual or a written explanation that describes how to use the parts to be provided (e.g., a testing drug, a diagnostic drug, and a therapeutic drug or how to treat reagents. In the present specification, in the case of using the kit as a reagent kit, the kit usually comprises an instruction manual or the like that describes how to use a testing kit, a diagnostic drug, a therapeutic drug, an antibody, etc.

In the present specification, "instruction manual" is a statement that explains a method used in the present invention to physicians or other users. This instruction manual describes words providing instructions for the detection method of the present invention, how to use a diagnostic drug, or the administration of a medicament or the like. Also, the instruction manual may describe words providing instructions for oral administration or administration to the esophagus (e.g., by injection) as an administration route. This instruction manual is prepared according to a format specified by regulatory authorities of a country (e.g., Ministry of Health, Labour and Welfare for Japan and Food and Drug Administration (FDA) for the U.S.A) where the present invention is executed, and stipulates that approval by the regulatory authorities has been received. The instruction manual is a so-called package insert and is usually provided in a paper version, though the instruction manual is not limited thereto. The instruction manual may be provided in the form of, for example, an electronic medium (e.g., homepage provided by the Internet, and e-mail).

Preferred Embodiments

Hereinafter, preferred embodiments of the present invention will be described. It is understood that the embodiments provided below are given for well understanding the present invention, and the scope of the present invention should not be limited to the description below. Thus, it is evident that those skilled in the art can appropriately make change or modification within the scope of the present invention in light of the description of the present specification. It is also understood that the following embodiments of the present invention can each be used alone or can be used in combination.

(Anti-FSTL1 Antibody)

In one aspect, the present invention provides an anti-FSTL1 antibody or a fragment or functional equivalent thereof (also collectively referred herein to as "anti-FSTL1 antibody, etc." or "antibody, etc. of the present invention"), wherein the antibody recognizes an epitope of one or more amino acids in a region selected from the group consisting of amino acid positions 48 to 100, 148 to 170 or 148 to 162, 193 to 228 or 193 to 216, 205 to 228, and 233 to 289 or 272 to 289 of SEQ ID NO: 2 (amino acid sequence of human FSTL1). An anti-FSTL1 antibody recognizing an epitope in a region concerned, or a fragment or functional equivalent thereof is preferred. In a preferred embodiment, the antibody recognizes an epitope in a region of amino acid positions 148 to 162 or 272 to 289 of SEQ ID NO: 2 (amino acid sequence of human FSTL1).

For the antibody according to the present invention, the epitope can correspond to a region of consecutive or non-consecutive 5 or more amino acids, 6 or more amino acids, 7 or more amino acids, 8 or more amino acids, 9 or more amino acids, 10 or more amino acids, 11 or more amino acids, or 12 or more amino acids in the region concerned, or a combination thereof.

In a preferred embodiment, the antibody for the anti-FSTL1 antibody of the present invention or the fragment or functional equivalent thereof recognizes an epitope in a region selected from the group consisting of amino acid positions 48 to 100, 148 to 162, 205 to 228, and 272 to 289 of SEQ ID NO: 1 (amino acid sequence of human FSTL1). These epitopes include those for which drug efficacy has been confirmed in animal tests. It is understood that #6-55, #7-34, and #13 recognize the 148-162 site. It is also understood that #5-2, #5-3, #5-8, #5-10, #5-43, #8-1, #8-4, #8-6, and #8-8 recognize amino acid positions 272 to 289. It is understood that #7 and #10 recognize amino acid positions 205 to 228. It is understood that #22 recognizes amino acid positions 193 to 216. It is understood that #33 recognizes amino acid positions 48 to 100. Further preferably, the antibody for the anti-FSTL1 antibody of the present invention or the fragment or functional equivalent thereof recognizes an epitope in a region selected from the group consisting of amino acid positions 148 to 162 and 205 to 228 of SEQ ID NO: 1 (amino acid sequence of human FSTL1). These epitopes include those recognized by antibodies confirmed to have stronger activity. In another preferred embodiment, the antibody recognizes an epitope in a region of amino acid positions 48 to 100, 148 to 162, or 205 to 228 of SEQ ID NO: 2 (amino acid sequence of human FSTL1). Although not wishing to be bound by any theory, these epitopes include those for which drug efficacy has been confirmed in in vitro or in vivo tests.

In an alternative embodiment, the antibody for the anti-FSTL1 antibody of the present invention or the fragment or functional equivalent thereof has particular CDR. Alternatively, the anti-FSTL1 antibody of the present invention or the fragment or functional equivalent thereof may be an antibody comprising an arbitrary sequence comprising a full-length CDR sequence, or an antigen binding fragment thereof, or an antibody comprising the variable region of a sequence related to a particular antibody of the present invention, or an antigen binding fragment thereof, wherein a framework region thereof contains the substitution, addition, or deletion of 1, 2, 3, 4, 5, 6, 7, 8, 9, 10, 12, 15, 17, or 20 or more amino acids. More specifically, as for such particular CDR, the antibody comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68) or functional equivalents thereof (e.g., containing the conservative substitution of 1, 2, or 3 or more amino acids) as specific examples of heavy chain CDR1, CDR2, and CDR3 and light chain CDR1, CDR2, and CDR3. Alternatively, the anti-FSTL1 antibody of the present invention or the fragment or functional equivalent thereof may be a mutant of the antibody, wherein the mutant contains the substitution, addition, or deletion of 1 or several amino acids in a framework of the antibody but contains no mutation in the CDR. Embodiments described in another section herein and/or an approach known in the art can be used in the production of the antibody, etc. For the treatment or prevention of the present invention, it is preferred that such an antibody or a fragment or functional equivalent thereof should have suppressive activity against FSTL1 or a signaling pathway downstream therefrom. Such activity may be confirmed by examining the expression level of FSTL1 or its activity, or by directly using a cancer cell line and examining, for example, the inhibition of cell growth, the inhibition of metastatic activity, the inhibition of bone metastasis, the inhibition of the activity of enhancing immune defect such as immunosuppression or immunodeficiency by MSCs (e.g., growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity), the inhibition of imparting of immunosuppressive or immunodeficient properties to immune-related cells (e.g., growth of regulatory T cells, increase in the immunosuppressive activity of regulatory T cells, differentiation into regulatory T cells, growth of regulatory dendritic cells, increase in the immunosuppressive activity of regulatory dendritic cells, differentiation into regulatory dendritic cells, growth of tolerogenic dendritic cells, increase in the immunosuppressive activity of tolerogenic dendritic cells, differentiation into tolerogenic dendritic cells, growth of myeloid-derived suppressor cells, increase in the immunosuppressive activity of myeloid-derived suppressor cells, differentiation into myeloid-derived suppressor cells, growth of exhausted T cells, enhancement of the immunodeficient activity of exhausted T cells, and expansion of exhausted T cells caused by growth, induction, etc. of exhausted T cells, cytotoxic activity by antibody-dependent cellular cytotoxicity (ADCC), or observed retraction of tumor implanted in model animals. An approach therefor is well known in the art, and an approach used herein may be used. In a particular embodiment, such an antibody of the present invention can be an antibody selected from a monoclonal antibody, a polyclonal antibody, a chimeric antibody, a humanized antibody, a human antibody, a multifunctional antibody, a bispecific or oligospecific antibody, a single-chain antibody, scFv, diabody, sc(Fv)2 (single chain (Fv)2), and scFv-Fc.

Herein, the amino acid sequences of CDRs of each antibody clone are underlined in the sequences of heavy and light chains.

5-2:
Light chain (L chain; SEQ ID NO: 6): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>PSDIPSRFSGSKSGSTATLTITGVQAEDEAVYFC<u>GGYDSSTGHGGI</u>FGAGTTLTVL

Heavy chain (H chain; SEQ ID NO: 8): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>GVGKDGGTGYGAAVDGRATISKDNGQSTLRLQLNNLRAEDTGTYYCAK</u><u>AAGGCSYGWCGSYVGDIDA</u>WGHGTEVIVSS

5-3
L chain (SEQ ID NO: 10): CDRs are underlined, and CDR1, CDR2, and CDR3 are shown in order from the N terminus.

ASTQPSSVSANPGETVKITC<u>SGGSGYYYG</u>WYQQKSPGSVPVTVIY<u>NNNNR</u>PSDIPSRFSGSKSGSTGTLTITGVRAEDEAVYYC<u>GGYDNSGTGI</u>FGAGTTLTVL

H chain (SEQ ID NO: 12): CDRs are underlined, and CDR1, CDR2, and CDR3 are shown in order from the N terminus.

AVTLDESGGGLQTPGGALSLVCKGSGFSFS<u>SFNMF</u>WVRQAPGKGLEWVA<u>GIGKDGVPKYGAAVDGRATISKDNGQSTMRLQLNNLRAEDTGTYFCAK</u><u>AAGGCSYDWCGIYAGDIDT</u>WGHGTEVIVSS

5-8
L chain (SEQ ID NO: 14): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>PSDIPSRFSGSKSGSTATLTITGVQAEDEAVYFC<u>GGYDSSTGHGGI</u>FGAGTTLTVL

H chain (SEQ ID NO: 16): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>GIGKDGVPKYGTAVDGRATISKDNGQSTMRLQLNNLRAEDTGTYFCAK</u><u>AAGGCSYDWCGIYTGDIDT</u>WGHGTEVIVSS

5-10
L chain (SEQ ID NO: 18): CDRs are underlined, and CDR1, CDR2, and CDR3 are shown in order from the N terminus.

ASTQPSSVSANPGETVKITC<u>SGGGSYVGSYYYG</u>WYQQKSPGSAPVTVIY<u>NNNQR</u>PSDIPSRFSGSKSGSTATLTITGVQAEDEAVYFC<u>GGYDSSAGGI</u>FGAGTTLTVL

H chain (SEQ ID NO: 20): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVA<u>GVGKDGGTTYGAAVDGRATISRDSGQSTVRLQLNDLRAEDTGTYFCAK</u><u>AAGGCSYSWCGAYVGDLDA</u>WGHGTEVIVSS

5-43
L chain (SEQ ID NO: 22): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>PSDIPSRFSGSKSGSTATLTITGVQAEDEAVYFC<u>GGYDSSTGHGGI</u>FGAGTTLTVL

H chain (SEQ ID NO: 24): CDRs are underlined, and CDR1, CDR2, and CDR3 are shown in order from the N terminus.

AVTLDESGGGLQTPGGGLSLVCKGSGTFTS<u>SFNMF</u>WVRQAPGKGLEWVA<u>GIGKDGGTGYGAAVDGRATISKDSGQSTLRLQLNNLRAEDTGTYYCAK</u><u>AAGGCSYDWCGAYTGDIDT</u>WGHGTEVIVSS

6-55
L chain (SEQ ID NO: 26): CDRs are underlined, and CDR1, CDR2, and CDR3 are shown in order from the N terminus.

ASTQPSSVSAIPGETVKITC<u>SGGGNNYG</u>WYQQRSPGSAPVTVIY<u>YNDNRP</u>SNIPSRFSGSTSGSTSTLTITGVQADDEAIYYC<u>GSWDSNTDSGI</u>FGAGTTLTVL

H chain (SEQ ID NO: 28): CDRs are underlined, and CDR1, CDR2, and CDR3 are shown in order from the N terminus.

AVTLDESGGGLQTPGGALSLVCKGSGFTFT<u>SVTMQ</u>WVRQAPGKGLEWVA<u>SVCSGSSTYYAPAVKGRATISRDNGQSTVRLQLSNLRPEDTGTYYCAK</u><u>IAGRARWSCTSAAYNIDA</u>WGHGTEVIVSS

7-34
L chain (SEQ ID NO: 30): CDRs are underlined, and CDR1, CDR2, and CDR3 are shown in order from the N terminus.

ASTQPSSVSANPGETVKITC<u>SGGGNNYG</u>WYQQKSPGSAPVTVI<u>YNNNRP</u>SNIPSRFSGSTSGSTSTLTITGVQAEDEAVYYC<u>GSYEGSTDSGI</u>FGAGTTLTVL

H chain (SEQ ID NO: 32): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVA<u>S
ICSGSSTYYGPAVKG</u>RATISRDNGQNTVRLQLNNLRAEDTATYYCAK<u>IVG
RGRWSCTSAAYNIDA</u>WGHGTEVIVSS

8-1
L chain (SEQ ID NO: 34): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR
PS</u>DIPSRFSGSKSGSTATLTITGVQAEDEAVYFC<u>GGYDSSSGHGG</u>IFGAG
TTLTVL

H chain (SEQ ID NO: 36): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVA<u>G
IGKDGVPKYGAAVDG</u>RATISKDNGQSTMRLQLNNLRAEDTGTYFCAK<u>AAG
GCSYDWCGIYAGDIDT</u>WGHGTEVIVSS

8-4
L chain (SEQ ID NO: 38): CDRs are underlined, and CDR1, CDR2, and CDR3 are shown in order from the N terminus.

ASSQPSSVSANPGETVKITC<u>SGGSGYYYG</u>WYQQKSPGSAPVTVIY<u>NNDNK
PS</u>DIPSRFSGSKSGSTGTLTITGVQVEDEAVYFC<u>GGYDNSGTGI</u>FGAGTT
LTVL

H chain (SEQ ID NO: 40): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVA<u>G
VGKDGGTAYGAAVDG</u>RATISRDSGQSTVRLQLNNLRAEDTGTYFCAK<u>AAG
GCSYSWCGAYVGDLDA</u>WGHGTEVIVSS

8-7
L chain (SEQ ID NO: 42): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR
PS</u>DIPSRFSGSKSGSTATLTITGVQAEDEAVYFC<u>GGYDSSTGHHGI</u>FGAG
TTLTVL

H chain (SEQ ID NO: 44): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G
IGKDGVPKYGAAVDG</u>RATISKDNGQSTLRLQLNNLRAEDTGTYFCAK<u>AAG
GCSYDWCGIYAGDIDT</u>WGHGTEVIVSS

8-8
L chain (SEQ ID NO: 46): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR
PS</u>DIPSRFSGSKSGSTATLTITGVQVEDEAVYFC<u>GGYDSSTGHHGI</u>FGAG
TTLTVL

H chain (SEQ ID NO: 48): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVA<u>G
IGKDGVPKYGAAVDG</u>RATISKDNGQSTMRLQLNNLRAEDTGTYYCAK<u>AAG
GCSYGWCGAYTGDIDT</u>WGHGTEVIVSS

7
L chain (SEQ ID NO: 50): CDRs are underlined, and CDR1, CDR2, and CDR3 are shown in order from the N terminus.

ASTQPSSVSANPGETVKITC<u>SGGGSRYG</u>WYQQKSPGSAPVTVIY<u>YNDKRP
SN</u>IPSRFSGSKSGSTGTLTITGVRAEDEAVYFC<u>GGYDGSTDAA</u>FGAGTTL
TVL

H chain (SEQ ID NO: 52): CDRs are underlined, and CDR1, CDR2, and CDR3 are shown in order from the N terminus.

AVTLDESGGGLQTPGGALSLVCKASGFFFF<u>SIYDMG</u>WVRQAPGKGLEWVA
<u>GIDDYGEYTGYGSAVKG</u>RATISRDNGQSTVRLQLNNLRAEDTGTYYCAR<u>G
AGTGCNSAGCGAYAGSIDA</u>WGHGTEVIVSP

10
L chain (SEQ ID NO: 54): CDRs are underlined, and CDR1, CDR2, and CDR3 are shown in order from the N terminus.

ASTQPSSVSANPGETVKLTC<u>SGGGSRYG</u>WYQQKSPGSAPVTVIY<u>YNDKRP
SD</u>IPSRFSGSKSGSTATLTITGVQAEDEAVYFC<u>GGYDGSRDAGI</u>FGAGTT
LTVL

H chain (SEQ ID NO: 56): CDRs are underlined, and CDR1, CDR2, and CDR3 are shown in order from the N terminus.

AVTLDESGGGLQTPGGALSLVCKASGFFFF<u>RIYDMG</u>WVRQAPGKGLEWVA
<u>GIDDYGRYTGYGSAVKG</u>RATISRDNGQSTVRLQLNNLRAEDTGTYYCAR<u>G
AGTGCNSAGCGAYAGSIDA</u>WGHGTEVIVSS

13
L chain (SEQ ID NO: 58): CDRs are underlined, and CDR1, CDR2, and CDR3 are shown in order from the N terminus.

ASTQPSSVSANPGETVKITC<u>SGGGNNYG</u>WYQQKSPGSAPVTVIY<u>NNNNRP
SN</u>IPSRFSGSKSGSTNTLTITGVQAEDEAVYYC<u>GSYDSSSDSGI</u>FGAGTT
LTVL

H chain (SEQ ID NO: 60): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVA<u>S</u>

<u>ICSGSSTYYGPAVKG</u>RATISRDNGQNTVRLQLNNLRAEDTATYYCAK<u>IVG</u>

<u>RGRWSCTSAAYNIDA</u>WGHGTEVIVSS

22

L chain (SEQ ID NO: 62): CDRs are underlined, and CDR1, CDR2, and CDR3 are shown in order from the N terminus.

ASTQPSSVSANPGETVKITC<u>SGGSGSYG</u>WFQQKSPGSAPVTVIY<u>WDDRRP</u>

<u>S</u>DIPSRFSGSKSGSIHTLTITGVQADDEAVYLC<u>GNAVRSGTGYVGV</u>FGAG

TTLTVL

H chain (SEQ ID NO: 64): CDRs are underlined, and CDR1, CDR2, and CDR3 are shown in order from the N terminus.

AVTLDESGGGLQTPGGALSLVCKASGFTFS<u>SNGMA</u>WVRQAPGKGLEWLVA

<u>RINSSGSYTNYGAAVKG</u>RATISRDNGQSTVRLQLNNLRAEDTGTYYCAK<u>G</u>

<u>ASGYGAYPGNIDA</u>WGHGTEVIVSS

33

L chain (SEQ ID NO: 66): CDRs are underlined, and CDR1, CDR2, and CDR3 are shown in order from the N terminus.

ASTQPSSVSANPGETVEITC<u>SGDSSYYG</u>WFQQKSPGSAPVTVIY<u>DNTNRP</u>

<u>S</u>DIPSRFSGSKSGSTATLTITGVRAEDEAVYYC<u>GGYDSSTYDGI</u>FGAGTT

LTVL

H chain (SEQ ID NO: 68): CDRs are underlined, and CDR1, CDR2, and CDR3 are shown in order from the N terminus.

AVTLDESGGGLQTPGGGLSLVCKASGFTFS<u>SFNMN</u>WVRQAPGKGLEYVAE

<u>ISGTGSSTYYGSAVKG</u>RATISRDNGQSTVRLQLNNLRAEDTATYFCAR<u>GD</u>

<u>GAYSIDA</u>WGHGTEVIVSS

In a preferred embodiment, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68) or functional equivalents thereof (e.g., containing the conservative substitution of 1, 2, or 3 or more amino acids). In these clones, stronger binding activity against FSTL1 was observed in Examples. It is understood that a clone carrying similar CDRs is expected to maintain this stronger binding activity, and exerts similar drug efficacy.

Further preferably, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), and #10 (light chain: SEQ ID NO: 54; heavy chain: SEQ ID NO: 56) or functional equivalents thereof (e.g., containing the conservative substitution of 1, 2, or 3 or more amino acids). In these clones, stronger drug efficacy was observed in Examples. It is understood that a clone carrying similar CDRs is expected to maintain this stronger drug efficacy.

In an alternative embodiment, the antibody for the anti-FSTL1 antibody of the present invention or the fragment or functional equivalent thereof has particular full-length variable regions. Such particular variable regions include the full-length variable regions of antibody #5-2 (light chain: SEQ ID NO: 6; heavy chain: SEQ ID NO: 8), #5-3 (light chain: SEQ ID NO: 10; heavy chain: SEQ ID NO: 12), antibody #5-8 (light chain: SEQ ID NO: 14; heavy chain: SEQ ID NO: 16), #5-10 (light chain: SEQ ID NO: 18; heavy chain: SEQ ID NO: 20), #5-43 (light chain: SEQ ID NO: 22; heavy chain: SEQ ID NO: 24), #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #8-4 (light chain: SEQ ID NO: 38; heavy chain: SEQ ID NO: 40), #8-7 (light chain: SEQ ID NO: 42; heavy chain: SEQ ID NO: 44), #8-8 (light chain: SEQ ID NO: 46; heavy chain: SEQ ID NO: 48), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60), #22 (light chain: SEQ ID NO: 62; heavy chain: SEQ ID NO: 64) and #33 (light chain: SEQ ID NO: 66; heavy chain: SEQ ID NO: 68) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises the full-length variable regions of an antibody selected from the group consisting of #6-55 (light chain: SEQ ID NO: 26; heavy chain: SEQ ID NO: 28), #7-34 (light chain: SEQ ID NO: 30; heavy chain: SEQ ID NO: 32), #8-1 (light chain: SEQ ID NO: 34; heavy chain: SEQ ID NO: 36), #7 (light chain: SEQ ID NO: 50; heavy chain: SEQ ID NO: 52), #10 (light chain: SEQ ID NO: 54; heavy chain: SEQ ID NO: 56), #13 (light chain: SEQ ID NO: 58; heavy chain: SEQ ID NO: 60) and #33 (light chain: SEQ ID NO: 66; heavy chain: SEQ ID NO: 68) or functional equivalents thereof (e.g., containing the conservative substitution of 1, 2, or 3 or more amino acids). In a preferred embodiment, the antibody for the anti-FSTL1 antibody of the present invention or the fragment or functional equivalent thereof comprises the full-length variable regions of an antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), and #10 (light chain: SEQ ID NO: 54; heavy chain: SEQ ID NO: 56) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises a full-length antibody selected from the group consisting of antibody #5-2 (light chain: SEQ ID NO: 96; heavy chain: SEQ ID NO: 898), #5-3 (light chain: SEQ ID NO: 100; heavy chain: SEQ ID NO: 102), antibody #5-8 (light chain: SEQ ID NO: 104; heavy chain: SEQ ID NO: 106), #5-10 (light chain: SEQ ID NO: 108; heavy chain: SEQ ID NO: 110), #5-43 (light chain: SEQ ID NO: 112; heavy chain: SEQ ID NO: 114), #6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #8-4 (light chain: SEQ ID NO: 128; heavy chain: SEQ ID NO: 130), #8-7 (light chain: SEQ ID NO: 132; heavy chain: SEQ ID NO: 134), #8-8 (light chain: SEQ ID NO: 136; heavy chain: SEQ ID NO: 138), #7 (light chain: SEQ ID NO: 140; heavy chain: SEQ ID NO: 142), #10 (light chain: SEQ ID NO: 144; heavy chain: SEQ ID NO: 146), #13 (light chain: SEQ ID NO: 148; heavy chain: SEQ ID NO: 150), #22 (light chain: SEQ ID NO: 152; heavy chain: SEQ ID NO: 154) and #33 (light chain: SEQ ID NO: 156; heavy chain: SEQ ID NO: 158) or a humanized sequence thereof.

In a preferred embodiment, the antibody for the anti-FSTL1 antibody of the present invention or the fragment or functional equivalent thereof comprises a full-length antibody selected from the group consisting of antibody #6-55 (light chain: SEQ ID NO: 116; heavy chain: SEQ ID NO: 118), #7-34 (light chain: SEQ ID NO: 120; heavy chain: SEQ ID NO: 122), #8-1 (light chain: SEQ ID NO: 124; heavy chain: SEQ ID NO: 126), #7 (light chain: SEQ ID NO: 140; heavy chain: SEQ ID NO: 142), #10 (light chain: SEQ ID NO: 54; heavy chain: SEQ ID NO: 56), #13 (light chain: SEQ ID NO: 148; heavy chain: SEQ ID NO: 150) and #33 (light chain: SEQ ID NO: 156; heavy chain: SEQ ID NO: 158) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 26; heavy chain: SEQ ID NO: 28), #7 (light chain: SEQ ID NO: 50; heavy chain: SEQ ID NO: 52), and #10 (light chain: SEQ ID NO: 54; heavy chain: SEQ ID NO: 56) or a humanized sequence thereof.

In a preferred embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 169, 171, 173, and 175, respectively) and L chain FR1, FR2, FR3, and FR4 (SEQ ID NOs: 185, 187, 189, and 191, respectively) of H(2)-L(1).

In a preferred embodiment, the humanized antibody of the present invention has a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), and a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 206, 207, 208, and 209, respectively) and light chain sequence FR1, FR2, FR3, and FR4 (SEQ ID NOs: 210, 211 or 214, 212 or 215, and 213, respectively) of corresponding chicken sequences, into amino acids in each of the chicken sequences. Preferably, the heavy chain framework sequence of H(2), i.e., SEQ ID NOs: 169, 171, 173, and 175 (humanized heavy chain sequence FR1, FR2, FR3, and FR4 of H(2)), or a sequence obtained by the mutation (back mutation) of one or more differing amino acids in the heavy chain framework sequence from heavy chain sequence FR1, FR2, FR3, and FR4 of a corresponding chicken sequence, into amino acids in the chicken sequence can be used. In the present specification, this is because use of H(2) was superior in activity by an order of magnitude in terms of $K_D$ value to H(1) and H(3). Also preferably, a light chain framework sequence comprising SEQ ID NOs: 185, 187, 189, and 191 (humanized light chain sequence FR1, FR2, FR3, and FR4, respectively, of L(1)) or a sequence obtained by the mutation (back mutation) of one or more differing amino acids in the light chain framework sequence from corresponding chicken light chain sequence FR1, FR2, FR3, and FR4 (SEQ ID NOs: 210, 211 or 214, 212 or 215, and 213, respectively) into amino acids in the chicken sequence can be used.

Further preferably, the humanized antibody has a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), or a sequence obtained by the mutation of 1 to 8 (e.g., 1, 2, 3, 4, 5, 6, 7, or 8) differing amino acids in the heavy chain framework sequence from corresponding chicken heavy chain sequence FR1, FR2, FR3, and FR4 (SEQ ID NOs: 206, 207, 208, and 209, respectively) into amino acids in the chicken sequence, and has a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or a sequence obtained by the mutation of 1 to 4 (e.g., 1, 2, 3, or 4) differing amino acids in the light chain framework sequence from corresponding chicken light chain sequence FR1, FR2, FR3, and FR4 (SEQ ID NOs: 210, 211 or 214, 212 or 215, and 213, respectively) into amino acids in the chicken sequence.

In a preferred embodiment, at least 1, more preferably at least 2, at least 3, at least 4, or at least 5 differing amino acids that are taken into consideration for the back mutation of the humanized antibody are selected from Vernier residues. It is understood that the mutation may involve amino acid residues other than the Vernier residues as long as the activity is optimized. In a preferred embodiment, all of the differing amino acids are selected from Vernier residues. For the Vernier residue, see, for example, Japanese Patent Laid-Open No. 2010-4895 and Nishibori N et al., Molecular Immunology 43 (2006) 634-642, the description of which is incorporated herein by reference.

The Vernier residues include FR1 amino acid (SEQ ID NO: 169) positions 28 and 30, FR2 amino acid (SEQ ID NO: 171) position 12, and FR3 amino acid (SEQ ID NO: 173) positions 2, 10, 13, 17, and 32 of the H chain of the humanized sequence, and FR1 (SEQ ID NO: 185) position 20 and FR3 amino acid (SEQ ID NO: 189) positions 10, 15, and 31 of the L chain. It is understood that the Vernier sequences may vary among different sequences.

In one embodiment, the antibody of the present invention is a humanized antibody having any of the H chain FR1, FR2, FR3, and FR4 and L chain FR1, FR2, FR3, and FR4 of H(1)-L(1), H(2)-L(1), H(3)-L(1), H(1)-L(2), H(2)-L(2), H(3)-L(2), H(1)-L(3), H(2)-L(3), or H(3)-L(3). In another embodiment, the antibody of the present invention is a humanized antibody having the H chain FR1, FR2, FR3, and FR4 (SEQ ID NOs: 169, 171, 173, and 175, respectively) and L chain FR1, FR2, FR3, and FR4 (SEQ ID NOs: 185, 187, 189, and 191, respectively) of H(2)-L(1).

In an alternative embodiment, the antibody of the present invention is a humanized antibody having a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), or a mutant containing the substitution, addition, and/or deletion of 1 to 10 amino acids thereof, and a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or a mutant containing the substitution, addition, and/or deletion of 1 to 10 amino acids thereof.

In a further alternative embodiment, the antibody of the present invention is a humanized antibody comprising a framework sequence consisting of a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), and a light chain framework sequence comprising SEQ ID NOs: 185, 187, 189, and 191 (humanized light chain sequence FR1, FR2, FR3, and FR4), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or a sequence containing the substitution, addition, and/or deletion of 1 to 10 amino acids, 1 to 9 amino acids, 1 to 8 amino acids, 1 to 7 amino acids, 1 to 6 amino acids, 1 to 5 amino acids, 1 to 4 amino acids, 1 to 3 amino acids, or 1 or 2 amino acids in the framework sequence.

A transformant can be prepared by transfecting a cell with a polynucleotide or vector encoding the antibody for the anti-FSTL1 antibody according to one embodiment of the present invention or the fragment or functional equivalent thereof. Use of this transformant permits preparation of the antibody for the anti-FSTL1 antibody according to the embodiments of the present invention or the fragment or functional equivalent thereof. The transformant may be a human or non-human mammalian (e.g., rat, mouse, guinea pig, rabbit, bovine, and monkey) cell. Examples of the mammalian cell include Chinese hamster ovary cells (CHO cells) and monkey cells COS-7. Alternatively, the transformant may be a bacterium of the genus *Escherichia*, a yeast, or the like.

For example, an *E. coli*-derived plasmid (e.g., pET-Blue), a *Bacillus subtilis*-derived plasmid (e.g., pUB110), a yeast-derived plasmid (e.g., pSH19), an expression plasmid for animal cells (e.g., pA1-11 and pcDNA3.1-V5/His-TOPO), a bacteriophage such as λ phage, or a virus-derived vector can be used as the vector described above. These vectors may contain a constituent necessary for protein expression, such as a promoter, a replication origin, or an antibiotic resistance gene. The vector may be an expression vector.

For example, a calcium phosphate method, lipofection, electroporation, an adenovirus-based method, a retrovirus-based method, or microinjection can be used as a method for transfecting the cell with the polynucleotide or vector described above (Shin Idenshi Kogaku Handobukku (New Gene Engineering Handbook in English), revised 4th edition, Yodosha Co., Ltd. (2003): 152-179). For example, a method described in "Tanpakushitsu Jikken Handobukku (Protein Experiment Handbook in English), Yodosha Co., Ltd. (2003): 128-142" can be used as a method for producing the antibody using cells. For example, ammonium sulfate, ethanol precipitation, protein A, protein G, gel filtration chromatography, anion- or cation-exchange chromatography, phosphocellulose chromatography, hydrophobic interaction chromatography, affinity chromatography, hydroxyapatite chromatography, or lectin chromatography can be used in the purification of the antibody (Tanpakushitsu Jikken Handobukku (Protein Experiment Handbook in English), Yodosha Co., Ltd. (2003): 27-52).

(Medicament and Anticancer Agent)

In one aspect, the present invention provides a medicament comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the medicament of the present invention.

In this aspect, the present invention provides the anti-FSTL1 antibody of the present invention or the fragment or functional equivalent thereof for use as a medicament. It is understood that an antibody of an arbitrary embodiment or arbitrary example described herein in the section (Anti-FSTL1 antibody), etc. can be used as the antibody or the fragment or functional equivalent thereof for use in the medicament of the present invention.

In this aspect, the present invention provides a method for treating or preventing a FSTL1-related disease, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides an anticancer agent comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the anticancer agent of the present invention.

In this aspect, the present invention provides the anti-FSTL1 antibody of the present invention or the fragment or functional equivalent thereof for the treatment or prevention of cancer. It is understood that an antibody of an arbitrary embodiment or arbitrary example described herein in the section (Anti-FSTL1 antibody), etc. can be used as the antibody or the fragment or functional equivalent thereof for the treatment or prevention of cancer of the present invention.

In this aspect, the present invention provides a method for treating or preventing cancer, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides a therapeutic or prophylactic agent for metastatic malignant tumor or metastasis of malignant tumor, comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof for the metastatic malignant tumor of the present invention.

In this aspect, the present invention provides the anti-FSTL1 antibody of the present invention or the fragment or functional equivalent thereof for the treatment or prevention of metastatic malignant tumor or metastasis of malignant tumor. It is understood that an antibody of an arbitrary embodiment or arbitrary example described herein in the section (Anti-FSTL1 antibody), etc. can be used as the antibody or the fragment or functional equivalent thereof for use in the treatment of metastatic malignant tumor of the present invention.

In this aspect, the present invention provides a method for treating or preventing metastatic malignant tumor or metastasis of malignant tumor, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

The disease targeted by the present invention is cancer. Examples thereof can include, but are not limited to, melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, and metastatic malignant tumor thereof. The cancer may be a cancer type highly expressing SNAIL and/or FSTL1. As for the expression of SNAIL and/or FSTL1, information obtained in the human tumor tissue analysis information site of Oncomine (see Table 1A in FIG. 126) provided by oncomine.com/resource/login.html explains that high expression is found in melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma. Therefore, it is understood that effects similar to those demonstrated in Examples are also produced for these cancer types.

(Oncomine Data)

In an alternative aspect, the present invention provides an inhibitor of metastasis of cancer cells, comprising the anti-FSTL1 antibody of the present invention or the fragment or functional equivalent thereof, and provides an inhibitor capable of inhibiting even bone metastasis, lung metastasis, liver metastasis, spleen metastasis, lymph node metastasis, or brain metastasis, particularly, bone metastasis or lung metastasis.

In this aspect, the present invention provides the anti-FSTL1 antibody of the present invention or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells. It is understood that an antibody of an arbitrary embodiment or arbitrary example described herein in the section (Anti-FSTL1 antibody), etc. can be used as the antibody or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells, according to the present invention.

In this aspect, the present invention provides a method for inhibiting metastasis (e.g., bone metastasis, lung metastasis, liver metastasis, spleen metastasis, lymph node metastasis, or brain metastasis) of cancer cells, particularly, for inhibiting bone metastasis or lung metastasis of cancer cells, comprising the step of administering an effective amount of the anti-FSTL1 antibody of the present invention or the fragment or functional equivalent thereof to a test subject in need thereof. Particularly, it has heretofore been considered that bone metastasis is very difficult to inhibit. Nonetheless, it has been found that this can be remarkably inhibited, as shown herein in Examples. In this respect as well, the superiority of the present invention is found. It is understood that an antibody of an arbitrary embodiment or arbitrary example described herein in the section (Anti-FSTL1 antibody), etc. can be used as the antibody or the fragment or functional equivalent thereof usable in the method of the present invention.

In a further alternative aspect, the present invention provides an inhibitor of induction or enhancement of immune defect such as immunosuppression or immunodeficiency by mesenchymal stem cells (MSCs), comprising the anti-FSTL1 antibody of the present invention or the fragment or functional equivalent thereof. The enhancement of immune defect such as immunosuppression or immunodeficiency includes at least one of growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity. The enhancement of immune defect such as immunosuppression or immunodeficiency by mesenchymal stem cells (MSCs) also conceptually encompasses induction of mesenchymal stem cells inducing immune defect such as immunosuppression or immunodeficiency. Such MSCs having high immunosuppressive ability are also known as activated MSCs or cancer-associated MSCs. Although not wishing to be bound by any theory, FSTL1 secreted from Snail-positive cancer cells or the like acts on so-called progenitor cells of MSCs so that the MSCs secrete an agent causing differentiation of progenitor cells of immunosuppressive cells into immunosuppressive immune-related cells (e.g., regulatory T cells, regulatory dendritic cells, tolerogenic dendritic cells, and myeloid-derived suppressor cells) and/or an agent promoting growth thereof, and/or an agent enhancing their immunosuppressive activity. As a result, the so-called progenitor cells become immunosuppressive cells, probably leading to an immunosuppressed state. Accordingly, the action of the anti-FSTL1 antibody as described in the invention of the present application probably suppresses the action of FSTL1 and consequently mitigate an immunosuppressed state.

Thus, in an alternative aspect, the present invention provides an inhibitor of acquirement and/or enhancement of activity of immune defect such as immunosuppression or immunodeficiency by or of immune-related cells, comprising the anti-FSTL1 antibody of the present invention or the fragment or functional equivalent thereof. The acquirement and/or enhancement of activity of immune defect such as immunosuppression or immunodeficiency by or of immune-related cells also includes the event of induction of immunosuppressive cells. Therefore, the inhibitor of acquirement and/or enhancement of activity of immune defect such as immunosuppression or immunodeficiency by or of immune-related cells conceptually includes an inhibitor of induction of cells having the activity of immune defect such as immunosuppression or immunodeficiency. It is understood that an antibody of an arbitrary embodiment or arbitrary example described herein in the section (Anti-FSTL1 antibody), etc. can be used as the antibody or the fragment or functional equivalent thereof usable in the method of the present invention.

In this aspect, the present invention provides the anti-FSTL1 antibody of the present invention or the fragment or functional equivalent thereof for the inhibition of acquirement and/or enhancement of activity of immune defect such as immunosuppression or immunodeficiency by or of immune-related cells. It is understood that an antibody of an arbitrary embodiment or arbitrary example described herein in the section (Anti-FSTL1 antibody), etc. can be used as the antibody or the fragment or functional equivalent thereof for the inhibition of acquirement and/or enhancement of activity of immune defect such as immunosuppression or immunodeficiency by or of immune-related cells according to the present invention.

In this aspect, the present invention provides a method for inhibiting acquirement and/or enhancement of immunosuppressive activity, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In one embodiment, the acquirement and/or enhancement of activity of immune defect such as immunosuppression or immunodeficiency for the inhibitor of the present invention includes at least 1, preferably at least 2, more preferably at least 3, more preferably at least 4, more preferably at least 5, more preferably at least 6, more preferably at least 7, more preferably at least 8, more preferably at least 9, more preferably at least 10, more preferably at least 11, more preferably at least 12, more preferably at least 13, more preferably at least 14, more preferably all selected from the group consisting of growth of regulatory T cells, enhancement of the immunosuppressive activity of regulatory T cells, differentiation into regulatory T cells, enhancement of the immunosuppressive activity of regulatory dendritic cells, growth of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of (expansion of or differentiation into) exhausted T cells.

In one aspect, the medicament, the anticancer agent, the therapeutic agent, or the inhibitor of the present invention may be combined with additional cancer treatment. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In a preferred embodiment, the present invention further includes a cell-killing agent in addition to the anti-FSTL1 antibody or the fragment or functional equivalent thereof. Thus, the composition, the agent, the medicament, etc. (therapeutic drug or prophylactic drug, etc.) of the present invention may comprise a complex molecule or may be conjugated therewith.

In the present specification, "cell-killing agent" is an agent likely to lyse cell membranes. In the case of a peptide, the cell-killing agent is called cytotoxic peptide. The cytotoxic peptide has various names in the art and is also referred to as, for example, "lytic peptide component", "cell-killing sequence", "cytolytic peptide (sequence)", or "cell membrane lytic peptide (sequence)". These terms are used interchangeably for the purpose of the present invention. Typical examples of such a cytotoxic agent can include those listed in Gail D. et al., Cancer Res 2008; 68: 9280-9290; Ian Krop and Eric P. Winer, Clin Cancer Res; 20 (1); 1-6; and K Naito et al., Leukemia (2000) 14, 1436-144, and can include maytansinoid, emtansine, and N-acetyl-γ-calicheamicin dimethylhydrazide (NAc-γ-calicheamicin, DMH) contained in CMA-676, though the cytotoxic agent is not limited thereto. As for the peptide, typical examples of the cell-killing peptide can include, but are not limited to, cell membrane lytic peptides, cell membrane potential-destabilizing peptides, cell membrane lytic/nucleic acid-binding peptides, and mitochondrial membrane-disrupting peptides.

If necessary, such a cell-killing agent may be bound to the binding agent (antibody, etc.) of the present invention via a spacer. In the present specification, "spacer" refers to a moiety that forms a chemical bond between chain polymer molecules so as to bridge the molecules, and is also called linker. Typical examples of the peptide spacer include, but are not limited to, a sequence of 0 to 5 amino acids consisting of G or P. The spacer is not essential and may be absent.

In the present invention, the combination of the anti-FSTL1 antibody, or fragment or functional equivalent thereof, and the cell-killing agent may be provided as a complex molecule. For exemplary explanation of such a molecule, the molecule can be interpreted as being formed by a cytotoxic moiety which corresponds to an explosive moiety and a moiety in charge of specificity for cancer cells which corresponds to a warhead moiety (e.g., a peptide or a sequence, typically an antibody, specifically binding to a receptor highly expressed in cancer cells) in combination. In the case of using a spacer, the complex molecule is constituted by cancer cell-specific binding agent+spacer+ cell-killing agent. In the present specification, an arbitrary cancer cell-specific binding agent, an arbitrary spacer, and an arbitrary cell-killing agent can be arbitrarily combined, and exemplary production and use methods thereof are described. Such a molecule may be produced usually by a chemical synthesis method or, when constituted by peptides, by a method of forcedly expressing the molecule by gene recombination, followed by purification, or a combined method thereof.

As for the use of the present invention, the expression of FSTL1 on the surface of cancer cells to be treated and the damage sensitivity of the cancer cells for the cell-killing agent are examined. On the basis of the results, the warhead and the explosive are selected, and a molecule optimal for the cancer cells is designed. The treatment can be performed by combining a custom-made peptide toxin obtained by chemical synthesis or the like, if necessary, with DDS containing atelocollagen or the like, followed by local administration or systemic administration.

The present invention has been found from working effects on Snail-positive cancer cells. Therefore, although not wishing to be bound by any theory, the target of the present invention can include cancer caused by Snail-positive cancer cells. Since some cancer cells cause EMT and express SNAIL, cells with "EMT" reportedly express SNAIL not only in such limited and several types of cancers but in really various cancer types. Examples of such cancer can include, but are not limited to, squamous cell cancer, melanoma, colorectal cancer, breast cancer, lymphoma, lung cancer, prostate cancer, kidney cancer, thyroid gland cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma.

An administration route effective for treatment is preferably used for the therapeutic drug and may be, for example, intravenous, subcutaneous, intramuscular, intraperitoneal, or oral administration. The dosage form may be, for example, an injection, a capsule, a tablet, or granules. In the case of administering the antibody or the polynucleotide, use as an injection is effective. An injectable aqueous solution may be preserved in, for example, a vial or a stainless container. Also, the injectable aqueous solution may be supplemented with, for example, saline, sugar (e.g., trehalose), NaCl, or NaOH. The therapeutic drug may be supplemented with, for example, a buffer (e.g., a phosphate buffer solution), a stabilizer, or a sustained-release agent such as an adjuvant.

In general, the composition, the medicament, the agent (therapeutic agent, prophylactic agent, etc.), etc. of the present invention comprises a therapeutically effective amount of the therapeutic agent or active ingredient, and a pharmaceutically acceptable carrier or excipient. In the present specification, the phrase "pharmaceutically acceptable" means that for use in animals, more specifically, humans, the material has been approved by government's regulatory authorities or is pharmacopeial or is listed in other generally accepted pharmacopoeia. "Carrier" used herein refers to a diluent, an adjuvant, an excipient, or a vehicle that is administered together with the therapeutic agent. Such a carrier may be a sterile liquid, for example, water or oil. The carrier includes those of petroleum, animal, plant, or synthetic origin and includes, but is not limited to, peanut oil, soybean oil, mineral oil, and sesame oil. In the case of orally administering the medicament, water is a preferred carrier. In the case of intravenously administering the pharmaceutical composition, saline or aqueous dextrose is a preferred carrier. Preferably, a saline solution or an aqueous dextrose or glycerol solution is used as a liquid carrier for an injectable solution. An appropriate excipient includes light anhydrous silicic acid, crystalline cellulose, mannitol, starch, glucose, lactose, sucrose, gelatin, malt, rice, wheat flour, chalk, silica gel, sodium stearate, glycerol monostearate, talc, sodium chloride, powdered skim milk, glycerol, propylene, glycol, water, ethanol, carmellose calcium, carmellose sodium, hydroxypropylcellulose, hydroxypropylmethylcellulose, polyvinyl acetal diethylaminoacetate, polyvinylpyrrolidone, gelatin, medium-chain fatty acid triglyceride, polyoxyethylene hydrogenated castor oil 60, saccharose, carboxymethylcellulose, corn starch, inorganic salts, and the like. If desired, the composition may also contain a small amount of a wetting agent or emulsifying agent, or a pH buffering agent. Such a composition may assume the form of a solution, a suspension, an emulsion, a tablet, a pill, a capsule, a powder, a sustained-release formulation, or the like. The composition may be formulated as a suppository using a traditional binder and carrier, for example, triglyceride. An oral formulation may contain a standard carrier such as a pharmaceutical grade of mannitol, lactose, starch, magnesium stearate, saccharin sodium, cellulose, or magnesium carbonate. Examples of an appropriate carrier are described in E. W. Martin, Remington's Pharmaceutical Sciences (Mark Publishing Company, Easton, U.S.A). Such a composition contains a therapeutically effective amount of a therapeutic agent, preferably a purified form, together with an appropriate amount of the carrier, so as to provide a dosage form appropriate for a patient. The formulation must be suitable for the mode of administration. In addition, for example, a surfactant, an excipient, a colorant, a flavor, a preservative, a stabilizer, a buffer, a suspending agent, a tonicity agent, a binder, a disintegrant, a lubricant, a flowability-promoting agent, and a corrigent may be contained therein.

In the case of administering the medicament of the present invention, various delivery systems are known, and the therapeutic agent of the present invention may be administered to an appropriate site (e.g., the esophagus) using such a system. Such a system includes, for example: encapsulation in liposomes, microparticles, and microcapsules; use of recombinant cells capable of expressing the therapeutic agent (e.g., polypeptide); and use of endocytosis mediated by a receptor. An introduction method is not limited and includes, intracutaneous, intramuscular, intraperitoneal, intravenous, subcutaneous, intranasal, epidural, and oral routes. The medicament may be administered through any suitable route, for example, by injection, by bolus injection, or by absorption through epithelial or mucocutaneous linings (e.g., the mouth, the rectus, and intestinal mucosa). If necessary, an inhalator or an atomizer may be used by use of an aerosol agent. Furthermore, the medicament may be administered together with another biologically active agent. The administration may be systemic or local. The present invention also permits direct administration to tumor.

In a preferred embodiment, the composition can be formulated as a pharmaceutical composition adapted to administration to humans according to a publicly known method. Such a composition can be administered by injection. Typically, the composition for administration by injection is a solution in a sterile isotonic aqueous buffer. If necessary, the composition may also contain a solubilizing agent and a local anesthetic, such as lidocaine, which lessens pain at an injection site. In general, ingredients are separately supplied or mixed and supplied together in a unit dosage form, and can be supplied, for example, as a freeze-dried powder or a water-free concentrate in a sealed container, such as an ampule or a sachet, which indicates the amount of the active agent. In the case of administering the composition by injection, the composition may be dispensed using injection bottles containing a sterile drug grade of water or saline. In the case of administering the composition by injection, an ampule with sterile water or saline for injection may be provided such that ingredients can be mixed before the administration.

The antibody, etc. the composition, the medicament, the agent (therapeutic agent, prophylactic agent, etc.), etc. of the present invention may be formulated in a neutral or salt form or as any other prodrug (e.g., ester). A pharmaceutically acceptable salt includes a salt formed with a free carboxyl group derived from hydrochloric acid, phosphoric acid, acetic acid, oxalic acid, tartaric acid, or the like, a salt formed with a free amine group derived from isopropylamine, triethylamine, 2-ethylaminoethanol, histidine, procaine, or the like, and a salt derived from sodium, potassium, ammonium, calcium, ferric hydroxide, or the like.

The amount of the therapeutic agent of the present invention effective for the treatment of a particular disorder or condition may vary depending on the properties of the disorder or the condition and can be determined by those skilled in the art according to a standard clinical technique on the basis of the description of the present specification. In some cases, use of in vitro assay may assist in the identification of the optimum dosage range. An accurate dose to be used in a formulation may also vary depending on an administration route and the severity of a disease or a disorder and should therefore be determined according to the judgment of a doctor in attendance and the situation of each patient. However, the dose may be, but is not particularly limited to, for example, 0.001, 1, 5, 10, 15, 100, or 1000 mg/kg body weight in one dose, or may be within the range of any two of these values. The dosing interval may be, but is not particularly limited to, for example, once or twice per 1, 7, 14, 21, or 28 days, or may be once or twice per the range of any two of these values. The dose, the dosing interval, and the administration method may be appropriately selected according to the age and body weight of a patient, symptoms, a target organ, etc. The therapeutic drug preferably comprises the active ingredient in a therapeutically effective amount, or an effective amount that exerts the desired action. In the case where a malignant tumor marker is significantly reduced after administration, the therapeutic drug may be judged as having therapeutic effects. The effective dose is predictable from a dose-response curve obtained from an in vitro or animal model test system.

In one embodiment of the present invention, "patient" includes a human or a non-human mammal (e.g., one or more of a mouse, a guinea pig, a hamster, a rat, a rodent, a rabbit, a pig, sheep, a goat, cattle, a horse, a cat, a dog, a marmoset, a monkey, a chimpanzee, and the like). Also, the patient may be a patient judged or diagnosed as having FSTL1- or Snail-positive malignant tumor. In this respect, it is preferred to conduct the judgment or diagnosis by detecting the protein level of FSTL1 or Snail.

The pharmaceutical composition or the agent (therapeutic agent, prophylactic agent, etc.) of the present invention can be provided as a kit. In a particular embodiment, the present invention provides a drug pack or kit comprising one or more containers packed with one or more ingredients of the composition or the medicament of the present invention. In some cases, information indicating governmental agency's approval for production, use, or distribution for administration to humans in a form specified by the governmental agency that regulates the production, use, or distribution of medicaments or biological products may be shown with such containers.

The kit of the present invention may also contain an expression vector encoding a protein that is used as the antibody, etc., the composition, the therapeutic agent, the prophylactic agent, or the medicament of the present invention. This protein forms a biologically active complex after being expressed, and may therefore be reconstituted. Such a kit also preferably contains a necessary buffer and reagent. In some cases, an instruction manual (package insert) for use of the kit, and/or information indicating governmental agency's approval for production, use, or distribution for administration to humans in a form specified by the governmental agency that regulates the production, use, or distribution of medicaments or biological products may be shown with such containers.

(General Technique)

Molecular biological approaches, biochemical approaches, and microbial approaches used herein are well known in the art and conventionally used. These approaches are described in, for example, Sambrook J. et al. (1989). Molecular Cloning: A Laboratory Manual, Cold Spring Harbor and Id., 3rd Ed. (2001); Ausubel, F. M. (1987). Current Protocols in Molecular Biology, Greene Pub. Associates and Wiley-Interscience; Ausubel, F. M. (1989). Short Protocols in Molecular Biology: A Compendium of Methods from Current Protocols in Molecular Biology, Greene Pub. Associates and Wiley-Interscience; Innis, M. A. (1990). PCR Protocols: A Guide to Methods and Applications, Academic Press; Ausubel, F. M. (1992). Short Protocols in Molecular Biology: A Compendium of Methods from Current Protocols in Molecular Biology, Greene Pub. Associates; Ausubel, F. M. (1995). Short Protocols in Molecular Biology: A Compendium of Methods from Current Protocols in Molecular Biology, Greene Pub. Associates; Innis, M. A. et al. (1995). PCR Strategies, Academic Press; Ausubel, F. M. (1999). Short Protocols in Molecular Biology: A Compendium of Methods from Current Protocols in Molecular Biology, Wiley, and annual updates; Sninsky, J. J.

et al. (1999). PCR Applications: Protocols for Functional Genomics, Academic Press, and Experimental Medicine, Suppl. "Experimental Methods for Gene Transfer & Expression Analysis", Yodosha Co., Ltd., 1997, the related parts (which may be the entire parts) of which are incorporated herein by reference.

DNA synthesis techniques and nucleic acid chemistry for preparing artificially synthesized genes are described in, for example, Gait, M. J. (1985). Oligonucleotide Synthesis: A Practical Approach, IRL Press; Gait, M. J. (1990). Oligonucleotide Synthesis: A Practical Approach, IRL Press; Eckstein, F. (1991). Oligonucleotides and Analogues: A Practical Approach, IRL Press; Adams, R. L. et al. (1992). The Biochemistry of the Nucleic Acids, Chapman & Hall; Shabarova, Z. et al. (1994). Advanced Organic Chemistry of Nucleic Acids, Weinheim; Blackburn, G. M. et al. (1996). Nucleic Acids in Chemistry and Biology, Oxford University Press; Hermanson, G. T. (1996). Bioconjugate Techniques, Academic Press, the related parts of which are incorporated herein by reference.

In the present specification, the oligonucleotide of the present invention may be synthesized, for example, by a standard method known in the art using, for example, an automatic DNA synthesis apparatus (e.g., commercially available from Biosearch Technologies, Inc., Applied Biosystems, Inc., etc.). For example, phosphorothioate oligonucleotide may be synthesized by the method of Stein et al. (Stein et al., 1988, Nucl. Acids Res. 16: 3209), and methylphosphonate oligonucleotide may be prepared by use of a controlled pore glass polymer support (Sarin et al., 1988, Proc. Natl. Acad. Sci. USA 85: 7448-7451) or the like.

In the present specification, the term "or" is used when "at least one or more" of the items listed in a sentence can be adopted. In the present specification, the phrase "within the range of two values" means that the range also includes the two values themselves.

References such as scientific literatures, patents, and patent applications cited herein are incorporated herein by reference in their entirety to the same extent as respectively described specifically.

The present invention is described above by showing preferred embodiments in order to facilitate understanding. Hereinafter, the present invention will be described with reference to Examples. However, the description mentioned above and Examples given below are provided merely for illustrative purposes and are not intended to limit the present invention. Thus, the scope of the present invention is limited by neither the embodiments nor Examples specifically described herein and is limited only by claims.

EXAMPLES

Hereinafter, the present invention will be further described with reference to Examples. However, the present invention is not intended to be limited by these examples.

<Example 1> Preparation of Anti-FSTL1 Antibody

Three 3-month-old Boris Brown chickens were intraperitoneally immunized with 100 µg of an antigen human FSTL1 (Novoprotein, Cat # CF23) (SEQ ID NO: 159) per shot per chicken. A complete Freund's adjuvant (Wako Pure Chemical Industries, Ltd., 014-09541) for primary immunization and an incomplete Freund's adjuvant (Wako Pure Chemical Industries, Ltd., 011-09551) for secondary, tertiary, and quaternary immunization were used in the intraperitoneal immunization with the antigen. For quinary immunization, the antigen diluted with PBS (phosphate buffered saline) was intravenously injected thereto. Blood was collected from the veins under the wings every other week, and antibody titers were confirmed by ELISA. The quaternary immunization was carried out for the three chickens, and one individual found to have the largest rise in antibody titer was subjected to quinary immunization, which was used as final immunization. Three days after final immunization, the spleen of the chicken was recovered, and lymphocytes were isolated by density gradient centrifugation using Ficoll paque PLUS (GE Healthcare Japan Corp., 17-1440-03), followed by RNA extraction using TRIzole Reagent (Life Technologies Corp., 15596026). cDNA was synthesized from the extracted RNA by RT-PCR using PrimeScript II 1st Strand cDNA Synthesis Kit (Takara Bio Inc., 6210A), and scFv phage libraries were prepared. The expression vector used was pPDS. The preparation of the scFv phage libraries was performed by the method described in the reference "Nakamura et al., J Vet Med Sci. 2004 Ju; 66 (7): 807-814".

FSTL1-specific phages were enriched by panning using the scFv phage libraries. The antigen used in the panning was human FSTL1 (Novoprotein, Cat # CF23) alone or two antigens for panning, human FSTL1 (R&D Systems, Inc., Cat #1694-FN-050) and mouse FSTL1 (R&D Systems, Inc., Cat #1738-FN-050), alternately used. Antibodies also having cross reactivity with mice were thereby obtained. The panning was performed according to the method described in the reference "Nakamura et al., J Vet Med Sci. 2004 Ju; 66 (7): 807-814". After the 5th round of panning, the reactivity of the libraries was confirmed by ELISA using human FSTL1- and mouse FSTL1-immobilized plates, and phage screening was conducted from a library whose reactivity started to rise. For scFv phage antibody sample preparation, E. coli was infected with a phage and plated over 2×YT Agar plate containing ampicillin (50 µg/ml, Nacalai Tesque, Inc., 02739-32), and the obtained colonies were cultured in a 2×YT liquid medium containing ampicillin. After infection with a helper phage, phage induction was performed in 2×YT liquid medium containing ampicillin (50 µg/ml), kanamycin (25 µg/ml, Meiji Seika Pharma Co., Ltd., GSl-RSS), and IPTG (100 µg/ml, Nacalai Tesque, Inc., 19742-94). The reactivity of scFv phage antibodies in the obtained culture supernatants was confirmed by ELISA using antigen-immobilized plates. In screening by ELISA, 1 µg/ml of human FSTL1 or mouse FSTL1 diluted with PBS was placed at 50 µl/well to a 96-well plate (Nalge Nunc International, Cat. No. 442404), and the antigen was immobilized overnight at 4° C. After the immobilization, the wells were blocked with PBS containing 25% Block Ace (DS Pharma Biomedical Co., Ltd, UK-B80) and reacted with the culture supernatants containing the scFv phage antibodies. A solution of HRP-labeled Goat anti-mouse IgG (H+L) (Kirkegaard & Perry Laboratories, Inc. (KPL), Cat. No. 474-1806) diluted 1000-fold with 10% Block Ace was added as a secondary antibody, and the color development of OPD used as a substrate was measured as absorbance at 490 nm and 630 nm using a plate leader (Bio-Rad Laboratories, Inc., Model 680). These conditions are summarized in Table 1.

(Table 1 Screening Conditions)

TABLE 1-1

| 1 | Immobilized antigen: | 50 µL/well | O/N, 4° C. | 1 µg/mL human or mouse FSTL1 |
|---|---|---|---|---|
| 2 | Blocking: | 250 µL/well | 60 min, 37° C. | 25% Block Ace/ PBS |

TABLE 1-1-continued

| | | | |
|---|---|---|---|
| 3 Primary antibody: | 50 µL/well | 60 min, 37° C. | scFv phage antibody-containing culture supernatant |
| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 mn | | |

(O/N means overnight.)

The DNA sequencing of the positive clones obtained by ELISA was outsourced to Eurofins Genomics K. K. to determine the sequences.

As for clones differing in sequence, chicken-derived antibody H chain variable region and L chain variable region genes were amplified by PCR with a scFv antibody-encoding DNA strand as a template. Then, the PCR products were digested with restriction enzymes SacII (New England BioLabs Japan Inc., Cat # R0157S) and NheI (New England BioLabs Japan Inc., Cat # R0131S). Next, the H chain variable region and L chain variable region genes were respectively recombined into mouse/chicken chimeric antibody (IgG1) expression vectors (expression vector for H chain: pcDNA4/myc-His, expression vector for L chain: pcDNA3/myc-His, Invitrogen Corp.) treated with the same restriction enzymes as above. CHO cells were transfected with the prepared H chain and L chain constructs. Then, the reactivity of culture supernatants was confirmed by ELISA using a human or mouse FSTL1 protein-immobilized solid phase. The mouse chimeric expression vector used was the vector described in Tateishi et al., J Vet Med Sci. 2008 April; 70 (4): 397-400.

Among the antibody clones (chicken-mouse chimeric antibodies) thus obtained, clone #5-2, #5-3, #5-8, #5-10, #5-43, #6-55, #7-34, #8-1, #8-4, #8-7, #8-8, #6-55, #7, #10, #13, #22, and #33 were used in experiments given below. The amino acid sequences of the light chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 6, 10, 14, 18, 22, 26, 30, 34, 38, 42, 46, 50, 54, 58, 62, and 66, respectively. The full-length amino acid sequences of the light chains thereof are represented by SEQ ID NOs: 96, 100, 104, 108, 112, 116, 120, 124, 128, 132, 136, 140, 144, 148, 152, and 156, respectively. The nucleic acid sequences of the light chain variable regions thereof are represented by SEQ ID NOs: 5, 9, 13, 17, 21, 25, 29, 33, 37, 41, 45, 49, 53, 57, 61, and 65, respectively. The full-length nucleic acid sequences of the light chains thereof are represented by SEQ ID NOs: 95, 99, 103, 107, 111, 115, 119, 123, 127, 131, 135, 139, 143, 147, 151, and 155, respectively. The amino acid sequences of the heavy chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 8, 12, 16, 20, 24, 28, 32, 36, 40, 44, 48, 52, 56, 60, 64, and 68, respectively. The full-length amino acid sequences of the heavy chains thereof are represented by SEQ ID NOs: 98, 102, 106, 110, 114, 118, 122, 126, 130, 134, 138, 142, 146, 150, 154, and 158, respectively. The nucleic acid sequences of the heavy chain variable regions thereof are represented by SEQ ID NOs: 7, 11, 15, 19, 23, 27, 31, 35, 39, 43, 47, 51, 55, 59, 63, and 67, respectively. The full-length nucleic acid sequences of the heavy chains thereof are represented by SEQ ID NOs: 97, 101, 105, 109, 113, 117, 121, 125, 129, 133, 137, 141, 145, 149, 153, and 157, respectively.

For the large-scale production of the antibody clones described above, cultured mammalian cells were transfected with the prepared H chain and L chain constructs using Expi293 Expression system (Invitrogen Corp., Cat # A14635). Then, the expressed antibodies were purified using Protein G Sepharose 4 Fast Flow (GE Healthcare Japan Corp., 17-018-02). The measurement of the binding activity of the obtained purified antibody of each clone against FSTL1 will be shown in Example 2.

<Example 2> Evaluation of Binding Activity of Purified Antibody Against FSTL1

The reactivity of the obtained antibody clones described above with FSTL1 was evaluated by ELISA under the following conditions.

(Table 2 ELISA conditions for binding activity evaluation of purified antibody) Antibodies used: anti-dinitrophenyl (DNP) antibody (negative control), #5-2, #5-3, #5-8, #5-10, #5-43, #6-55, and #7-34

TABLE 1-2

| | | | |
|---|---|---|---|
| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |
| 3 Primary antibody: | 50 µL/well | 60 min, 37° C. | Each antibody serially diluted 2-fold from 1 µg/mL/10% Block Ace |
| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 mn | | |

O/N means overnight.

As a result, binding activity specific for human FSTL1 was confirmed. The strength of the binding activity was compared and was consequently #6-55, #7-34, and #5-10>#5-3>#5-8>#5-43 (FIG. 1A). Among the antibody clones, #6-55 and #7-34 exhibited specific and equivalently strong binding activity against both human and mouse FSTL1 (FIG. 1B).

Figure 2:
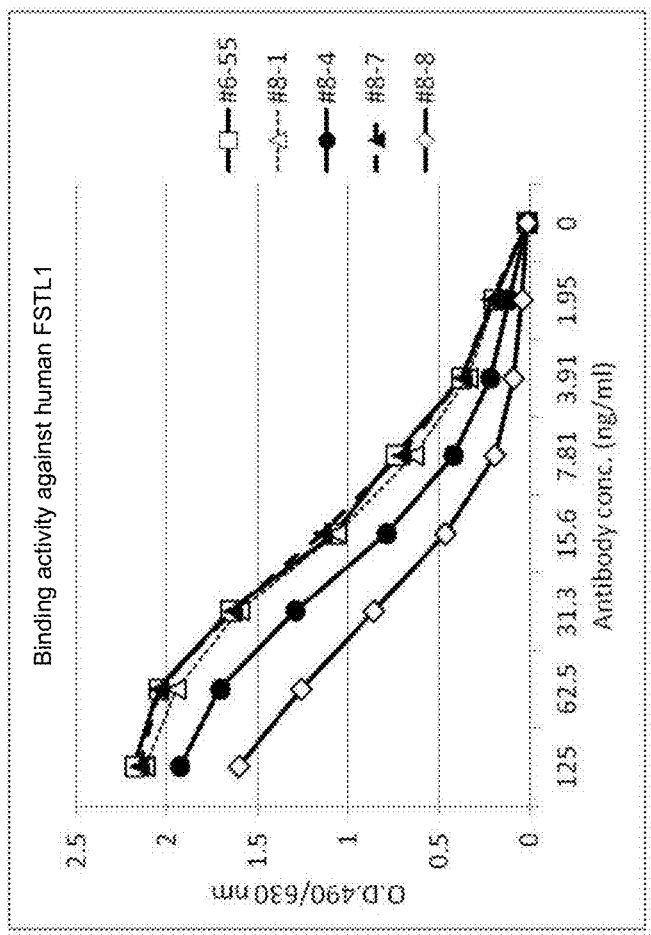
FIG. 2 shows results of evaluating the binding activity of clones obtained by middle screening against human FSTL1 by ELISA (Example 2). The open square depicts clone #6-55, the open triangle depicts clone #8-1, the filled circle depicts clone #8-4, the filled triangle depicts clone #8-7, and the open rhomboid depicts clone #8-8. The assay was conducted together with #6-55 for comparison. The strength of the binding activity was clone #6-55, #8-1, and #8-7>#8-4>#8-8. *The antibody concentration in FIG. 2 was diluted from 125 ng/ml.
Figure 3:
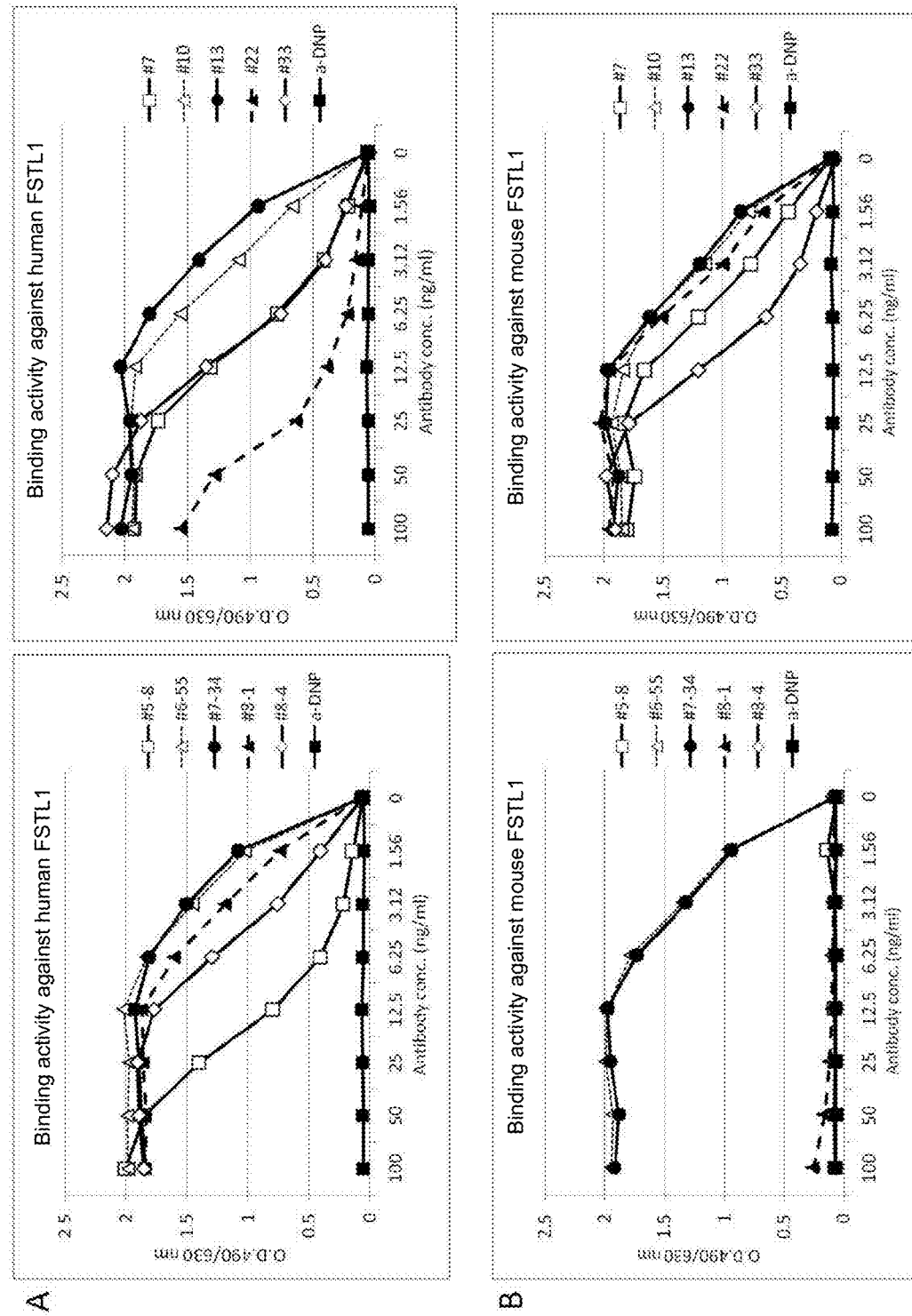
FIG. 3 is graphs showing the binding activity of clones obtained by panning using mouse FSTL1 (Example 2). The right and left graphs of part A or the right and left graphs of part B show results that were obtained by evaluation at the same time but were indicated by two divided graphs for the sake of the visibility of the figure due to a large number of clones.

FIGS. 2 and 3 show results of evaluating binding activity under the condition of Table 3 as to clones differing in screening and antibody purification timings.

(Table 3 ELISA conditions for binding activity evaluation of purified antibody) Antibodies used: anti-DNP antibody, #5-8, #6-55, #7-34, #8-1, #8-4, #8-7, #8-8, #7, #10, #13, #22, and #33

TABLE 1-3

| | | | |
|---|---|---|---|
| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |
| 3 Primary antibody: | 50 µL/well | 60 min, 37° C. | Each antibody serially diluted 2-fold from 125 or 100 ng/mL/10% Block Ace |

TABLE 1-3-continued

| 4 | Secondary antibody: | 50 µL/well | 60 min, 37° C. | HRP-anti-mouse IgG (H + L) in 10% Block Ace/PBS (1:1000) |
| 5 | Chromogenic substrate: | 50 µL/well | 30 min, RT | OPD solution |
| 6 | Reaction termination: | 50 µL/well | | 2N H$_2$SO$_4$ |
| 7 | Measurement: | | Wavelength 490 nm/630 nm | |

O/N means overnight.

(Results)

Binding activity specific for human FSTL was confirmed. The strength of the binding activity was compared and was consequently #6-55 and #8-1>#8-7>#8-4>#8-8 (FIG. 2). As a result of further evaluating binding activity against human and mouse FSTL1, the strength of the binding activity against human FSTL1 was #6-55, #7-34, and #13>#8-1 and #10>#8-4>#7 and #33>#5-8>#22 (FIG. 3A). The strength of the binding activity against mouse FSTL1 was #6-55, #7-34, #10, and #13>#22>#7>#33>#8-1, and #8-1 very slightly exhibited binding activity (FIG. 3B). #5-8 and #8-4 exhibited no binding activity against mouse FSTL1.

<Example 3> Epitope Mapping of Antibody

In this Example, the antibodies obtained by preceding Examples were subjected to epitope mapping.
<Gene Synthesis>
For the synthesis of human and mouse FSTL1 genes, the sequences of His-tagged human and mouse FSTL1 genes were designed with reference to sequence information on NM_007085.4 (SEQ ID NO: 1) of the human FSTL1 gene and NM_008047.5 (SEQ ID NO: 3) of the mouse FSTL1 gene such that 3 alanine residues and 10 histidine residues were added to the C terminus. Further, codons were optimized in consideration of expression in mammalian cells. Genes in which nucleic acid sequences for plasmid insertion (SEQ ID NOs: 75 and 76) were respectively added to both ends of each gene were designed, and their synthesis was outsourced to Life Technologies Corp. The nucleic acid and amino acid sequences (SEQ ID NOs: 1, 2, 3, and 4) of the original human and mouse FSTL1 and the nucleic acid sequences of the actually synthesized genes and their amino acid sequences after translation (SEQ ID NOs: 69, 70, 71, and 72) are shown below.
Sequence for insertion to plasmids: for N terminus:

(SEQ ID NO: 75)
5'-CGAACCCTTAAGCTTG-3' for C terminus:

5'-CGTGGCATCTAGACA-3  (SEQ ID NO: 76)

human FSTL1 nucleic acid sequence (SEQ ID NO: 1) <In the following sequences, a leader sequence is underlined> atgtggaaacgctggctcgcgctcgcgctcgcgctggtggcggtcgcctg ggtccgcgccgaggaagagctaaggagcaaatccaagatctgtgccaatg tgttttgtggagccggccgggaatgtgcagtcacagagaaggggaaccc acctgtctctgcattgagcaatgcaaacctcacaagaggcctgtgtgtgg cagtaatggcaagacctacctcaaccactgtgaactgcatcgagatgcct gcctcactggatccaaaatccaggttgattacgatggacactgcaaagag aagaaatccgtaagtccatctgccagcccagttgtttgctatcagtccaa ccgtgatgagctccgacgtcgcatcatccagtggctggaagctgagatca ttccagatggctggttctctaaaggcagcaactacagtgaaatcctagac aagtattttaagaactttgataatggtgattctcgcctggactccagtga attcctgaagtttgtggaacagaatgaaactgccatcaatattacaacgt atccagaccaggagaacaacaagttgcttaggggactctgtgttgatgct ctcattgaactgtctgatgaaaatgctgattggaaactcagcttccaaga gtttctcaagtgcctcaacccatctttcaaccctcctgagaagaagtgtg ccctggaggatgaaacgtatgcagatggagctgagaccgaggtggactgt aaccgctgtgtctgtgcctgtggaaattgggtctgtacagccatgacctg tgacggaaagaatcagaagggggcccagacccagacagaggaggagatga ccagatatgtccaggagctccaaaagcatcaggaaacagctgaaaagacc aagagagtgagcaccaaagagatctaa Mouse FSTL1 nucleic acid sequence (SEQ ID NO: 3)

atgtggaaacgatggctggcgctctcgctggtgaccatcgccctggtcca cggcgaggaggaacctagaagcaaatccaagatctgcgccaatgtgtttt gtggagctggcagggaatgtgccgtcacagagaagggggagcccacgtgc ctctgcattgagcaatgcaaacctcacaagaggcctgtgtgtggcagtaa tggcaagacctacctcaaccactgtgaacttcatagagatgcctgcctca ctggatccaagatccaggttgattatgatgggcactgcaaagaaaagaag tctgcgagtccatctgccagcccagttgtctgctatcaagctaaccgcga tgagctccgacggcgcctcatccagtggctggaagctgagatcattccag atggctggttctctaaaggcagtaactacagtgagatcctagacaagtac tttaagagctttgataatggcgactctcacctggactccagtgaattcct gaaattcgtggagcagaatgaaacagccatcaacatcaccacttatgcag atcaggagaacaacaaactgctcagaagcctctgtgttgacgccctcatt gaactgtctgatgagaacgctgactggaaactcagcttccaagagttcct caagtgcctcaacccatccttcaaccctcctgagaagaagtgtgccctgg aggacgaaacctatgcagatggagctgagactgaggtggactgcaatcgc tgtgtctgttcctgtggccactgggtctgcacagcaatgacctgtgatgg aaagaatcagaaggggtccagacccacacagaggaggagaagacaggat atgtccaggaactccagaagcaccagggcacagcagaaaagaccaagaag gtgaacaccaaagagatctaa Nucleic acid sequence of human FSTL1 used in Examples (SEQ ID NO: 69)

atgtggaagagatggctggccctggctctggcactggtggctgtggcttg ggtgcgcgccgaggaagaactgcggagcaagagcaagatctgcgccaacg tgttctgcggagccggcagagaatgtgccgtgaccgagaagggcgagcct -continued
acctgcctgtgcatcgagcagtgcaagccccacaagaggcctgtgtgcgg cagcaacggcaagacctacctgaaccactgcgagctgcaccgggatgcct gtctgaccggcagcaagatccaggtggactacgacggccactgcaaagaa aagaaaagcgtgtccccagcgccagcccgtcgtgtgttaccagagcaa cagggacgagctgcggcggagaatcatccagtggctggaagccgagatca tccccgacggctggttcagcaagggcagcaactacagcgagatcctggac aagtacttcaagaacttcgacaacggcgacagcagactggacagcagcga gttcctgaagttcgtggaacagaacgagacagccatcaacatcaccacct accccgaccaggaaaacaacaagctgctgcggggcctgtgcgtggacgcc ctgattgagctgagcgacgagaacgccgactggaagctgagctttcagga atttctgaagtgcctgaaccccagcttcaaccccccgagaagaagtgcg ccctggaggacgagacatacgccgatggcgccgagacagaggtggactgc aacagatgcgtgtgcgcctgcggcaactgggtgtgcaccgccatgacctg cgacggcaagaatcagaagggcgcccagacccagaccgaagaagagatga ccagatacgtgcaggaactgcagaagcaccaggaaaccgccgaaaagacc aagcgggtgtccaccaaagagatcgccgctgcccaccaccatcaccatca tcaccaccaccattga Nucleic acid sequence of mouse FSTL1 used in examples (SEQ ID NO: 71)

<u>atgtggaagcggtggctggccctgagcctcgtgacaattgctctggtgca</u>

<u>cggc</u>gaggaagaacccagaagcaagagcaagatctgcgccaacgtgttct gcggagccggcagagaatgtgccgtgaccgagaagggcgagcctacctgc ctgtgcatcgagcagtgcaagccccacaagaggcctgtgtgcggcagcaa cggcaagacctacctgaaccactgcgagctgcaccgggatgcctgtctga ccggcagcaagatccaggtggactacgacggccactgcaaagagaagaag tccgccagccctagcgccagcccagtcgtgtgttaccaggccaaccggga cgagctgcggcggagactgattcagtggctggaagccgagatcatccccg acggctggttcagcaagggcagcaactacagcgagatcctggacaagtac ttcaagagcttcgacaacggcgacagccacctggacagcagcgagttcct gaagttcgtggaacagaacgagacagccatcaacatcaccacctacgccg accaggaaaacaacaagctgctgagaagcctgtgcgtggacgccctgatc gagctgagcgacgagaacgccgactggaagctgagctttcaggaatttct gaagtgcctgaaccccagcttcaaccccccgagaagaaatgcgccctgg aagatgagacatacgccgacgcgccgagacagaggtggactgcaataga tgcgtgtgcagctgcggccactgggtgtgcaccgccatgacctgcgacgg caagaaccagaaggcgtgcagacccacaccgaggaagagaaaaccggct acgtgcaggaactgcagaagcaccagggcaccgccgaaaagaccaagaaa gtgaacaccaaagagatcgccgctgcccaccaccatcaccatcatcacca ccaccattga Human FSTL1 amino acid sequence (SEQ ID NO: 2)

<u>MWKRWLALALALVAVAWVRA</u>EEELRSKSKICANVFCGAGRECAVTEKGEP

TCLCIEQCKPHKRPVCGSNGKTYLNHCELHRDACLTGSKIQVDYDGHCKE

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCDGKNQKGAQTQTEEEMTRYVQELQKHQETAEKT

KRVSTKEI

Mouse FSTL1 amino acid sequence (SEQ ID NO: 4)

<u>MWKRWLALSLVTIALVHG</u>EEEPRSKSKICANVFCGAGRECAVTEKGEPTC

LCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

CVCSCGHWVCTAMTCDGKNQKGVQTHTEEEKTGYVQELQKHQGTAEKTKK

VNTKEI

Amino acid sequence of human FSTL1 used in Examples (SEQ ID NO: 70)

<u>MWKRWLALALALVAVAWVRA</u>EEELRSKSKICANVFCGAGRECAVTEKGEP

TCLCIEQCKPHKRPVCGSNGKTYLNHCELHRDACLTGSKIQVDYGDHCKE

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCDGKNQKGAQTQTEEEMTRYVQELQKHQETAEKT

KRVSTKEIAAAHHHHHHHHHH

Amino acid sequence of mouse FSTL1 used in Examples (SEQ ID NO: 71)

<u>MWKRWLALSLVTIALVHG</u>EEEPRSKSKICANVFCGAGRECAVTEKGEPTC

LCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

CVCSCGHWVCTAMTCDGKNQKGVQTHTEEEKTGYVQELQKHQGTAEKTKK

VNTKEIAAAHHHHHHHHHH

<Expression Vector Construction>

Next, the insertion of a multicloning site into pcDNA3.4TOPO® and a method for inserting the FSTL1 gene will be described.

The synthesis of sequences having a multicloning site given below was outsourced to FASMAC Corp. to synthesis single-stranded DNAs. Respective single-stranded DNAs are complementary to each other, and the synthesized single-stranded DNAs were prepared into a double strand and then inserted to pcDNA 3.4 TOPO® vector using pcDNA™3.4-TOPO® TA Cloning Kit (Life Technologies Corp., Cat # A14697).

Multicloning Site Sequence

```
                                              (SEQ ID NO: 73)
5'-AAGCTTGGATCCACTAGTGAATTCATCTACCAGCTAGCGTGGCATCT

AGACACTCTCGAGA-3'

(SEQ ID NO: 74)
5'-CTCGAGAGTGTCTAGATGCCACGCTAGCTGGTAGATGAATTCACTAG

TGGATCCAAGCTTA-3'
```

E. coli was transformed with the plasmid obtained by the insertion of the multicloning site, and cultured, and plasmids were purified using PureYield™ Plasmid Midiprep System (Promega Corp., Cat # A2492). The purified plasmids were treated with restriction enzymes BamHI-HF (New England BioLabs Japan Inc. Cat # R3136L) and NheI-HF (New England BioLabs Japan Inc. Cat # R3131L) and subjected to 1% agarose electrophoresis. After the electrophoresis, the gels were stained with ethidium bromide, and the bands of the plasmids were excised. The plasmids were purified from the gels using NucleoSpin Gel and PCR Clean-up (Takara Bio Inc., Cat #740609.250).

The synthesized human FSTL1 (SEQ ID NO: 69) or mouse FSTL1 gene (SEQ ID NO: 71) was integrated into the plasmids treated with the restriction enzymes described above using GeneArt Seamless Cloning and Assembly Enzyme Mix (Invitrogen Corp., Cat # A14606), and E. coli was transformed with the resulting plasmids. The transformed E. coli was cultured. Plasmids were extracted and purified from the E. coli, and their DNA sequences were confirmed. Plasmids confirmed to have the intended human or mouse FSTL1 gene sequence as a result of the DNA sequencing were used as expression plasmids. The obtained human and mouse FSTL1 expression vectors were used in transient expression using Expi293™ Expression system (Life Technologies Corp., Cat # A14635). Culture supernatants after the expression were purified using HisPur Cobalt Resin (Thermo Fisher Scientific Inc., Cat #89964) and used as antigens for ELISA and epitope mapping ELISA.

<Preparation of FSTL1 Deletion Mutant>

Next, a method for preparing various deletion mutants will be shown. Expression vectors of deletion mutants were constructed using the human FSTL1 expression plasmid thus prepared as a template, primers for deletion mutant preparation, and KOD-Plus-Mutagenesis Kit (Toyobo Co., Ltd., Cat # SMK-101). The sites to be deleted were selected, except for sites rich in disulfide bond important for conformation, with reference to Uniprot No. Q12841 (see FIG. 4A) to prepare expression vectors of a deletion mutant containing deletion at amino acid positions 21 to 53 (Δ21-53), a deletion mutant containing deletion at amino acid positions 100 to 140 (Δ100-140), a deletion mutant containing deletion at amino acid positions 148 to 170 (Δ148-170), a deletion mutant containing deletion at amino acid positions 148 to 154 (Δ148-154), a deletion mutant containing deletion at amino acid positions 155 to 162 (Δ155-162), a deletion mutant containing deletion at amino acid positions 163 to 170 (Δ163-170), a deletion mutant containing deletion at amino acid positions 181 to 190 (Δ181-190), a deletion mutant containing deletion at amino acid positions 193 to 228 (Δ193-228), and a deletion mutant containing deletion at amino acid positions 233 to 289 (Δ233-289). These various deletion mutants were transiently expressed using Expi293™ Expression system. Culture supernatants after the expression were purified using HisPur Cobalt Resin and used as antigens for epitope mapping ELISA.

```
Δ21-53 (Forward primer)
                                              (SEQ ID NO: 77)
5'-TGCATCGAGCAGTGCAAGCCCCACA-3'

Δ21-53 (Reverse primer)
                                              (SEQ ID NO: 78)
5'-GGCGCGCACCCAAGCCACAGCCACC-3'

Δ100-140 (Forward primer)
                                              (SEQ ID NO: 79)
5'-AAGGGCAGCAACTACAGCGAGATCC-3'

Δ100-140 (Reverse primer)
                                              (SEQ ID NO: 80)
5'-TTTGCAGTGGCCGTCGTAGTCCACC-3'

Δ148-170 (Forward primer)
                                              (SEQ ID NO: 81)
5'-TTCGTGGAACAGAACGAGACAGCCA-3'

Δ148-170 (Reverse primer)
                                              (SEQ ID NO: 82)
5'-CTCGCTGTAGTTGCTGCCCTTGCTG-3'

Δ181-190 (Forward primer)
                                              (SEQ ID NO: 83)
5'-AAGCTGCTGCGGGGCCTGTGCGTGG-3'

Δ181-190 (Reverse primer)
                                              (SEQ ID NO: 84)
5'-GTTGATGGCTGTCTCGTTCTGTTCC-3'

Δ193-228 (Forward primer)
                                              (SEQ ID NO: 85)
5'-CCCGAGAAGAAGTGCGCCCTGGAGG-3'

Δ193-228 (Reverse primer)
                                              (SEQ ID NO: 86)
5'-CAGCTTGTTGTTTTCCTGGTCGGGG-3'

Δ233-289 (Forward primer)
                                              (SEQ ID NO: 87)
5'-CTGCAGAAGCACCAGGAAACCGCCG-3'

Δ233-289 (Reverse primer)
                                              (SEQ ID NO: 88)
5'-CTTCTTCTCGGGGGGGTTGAAGCTG-3'

Δ148-154 (Forward primer)
                                              (SEQ ID NO: 89)
5'-AACTTCGACAACGGCGACAGCAGACT-3'

Δ148-154 (Reverse primer)
                                              (SEQ ID NO: 90)
5'-CTCGCTGTAGTTGCTGCCCTTGCTG-3'

Δ155-162 (Forward primer)
                                              (SEQ ID NO: 91)
5'-CTGGACAGCAGCGAGTTCCTGAAGT-3'

Δ155-162 (Reverse primer)
                                              (SEQ ID NO: 92)
5'-CTTGAAGTACTTGTCCAGGATCTCG-3'

Δ163-170 (Forward primer)
                                              (SEQ ID NO: 93)
5'-TTCGTGGAACAGAACGAGACAGCCA-3'

Δ163-170 (Reverse primer)
                                              (SEQ ID NO: 94)
5'-TCTGCTGTCGCCGTTGTCGAAGTTC-3'

Δ193-204 (Forward primer)
                                              (SEQ ID NO: 216)
5'-AGCGACGAGAACGCCGACTGG-3'
```

-continued

Δ193-204 (Reverse primer)
(SEQ ID NO: 217)
5'-CAGCTTGTTGTTTTCCTGGTCGGGG-3'

Δ205-216 (Forward primer)
(SEQ ID NO: 218)
5'-GAATTTCTGAAGTGCCTGAAC-3'

Δ205-216 (Reverse primer)
(SEQ ID NO: 219)
5'-CAGCTCAATCAGGGCGTCCAC-3'

Δ217-228 (Forward primer)
(SEQ ID NO: 220)
5'-CCCGAGAAGAAGTGCGCCCTGGAGG-3'

Δ217-228 (Reverse primer)
(SEQ ID NO: 221)
5'-CTGAAAGCTCAGCTTCCAGTC-3'

Δ233-251 (Forward primer)
(SEQ ID NO: 222)
5'-AGATGCGTGTGCGCCTGCGGC-3'

Δ233-251 (Reverse primer)
(SEQ ID NO: 223)
5'-CTTCTTCTCGGGGGGGTTGAAGCTG-3'

Δ252-270 (Forward primer)
(SEQ ID NO: 224)
5'-AATCAGAAGGGCGCCCAGACC-3'

Δ252-270 (Reverse primer)
(SEQ ID NO: 225)
5'-GTTGCAGTCCACCTCTGTCTCG-3'

Δ271-289 (Forward primer)
(SEQ ID NO: 226)
5'-CTTCTTCTCGGGGGGTTGAAGCTG-3'

Δ271-289 (Reverse primer)
(SEQ ID NO: 227)
5'-CTTGCCGTCGCAGGTCATGGCG-3'

Δ48-100 (Forward primer)
(SEQ ID NO: 228)
5'-AAGAAAAGCGTGTCCCCCAGC-3'

Δ48-100 (Reverse primer)
(SEQ ID NO: 229)
5'-CTTCTCGGTCACGGCACATTC-3'

<Epitope Mapping ELISA>

Epitope mapping ELISA was conducted using the antigens thus prepared and antibodies given below. Antibodies used: various chicken-mouse chimeric antibodies obtained in Example 1, a rat anti-FSTL1 antibody (R&D Systems, Inc., Cat. No. MAB1694, clone 229007) evaluated in Examples of the patent literature WO2009/028411, an anti-DNP antibody as a negative control, and a rat IgG2b isotype control (R&D Systems, Inc., Cat. No. MAB0061, clone 141945)

(Table 4 Epitope Mapping ELISA Conditions)

TABLE 1-4

| 1 | Immobilized antigen: | 50 μL/well | O/N, 4° C. | 5 μg/mL various human FSTL1 deletion mutants |
| 2 | Blocking: | 250 μL/well | 60 min, 37° C. | 25% Block Ace/PBS |
| 3 | Primary antibody: | 50 μL/well | 60 min, 37° C. | Each antibody 1 μg/mL/10% Block Ace |

TABLE 1-4-continued

| 4 | Secondary antibody: | 50 μL/well | 60 min, 37° C. | HRP-anti-mouse IgG (H + L) or HRP-anti-Rat IgG (H + L) (Cell Signaling Technology, Inc., #7077S) in 10% Block Ace/PBS (1:1000) |
| 5 | Chromogenic substrate: | 50 μL/well | 30 min, RT | OPD solution |
| 6 | Reaction termination: | 50 μL/well | | 2N $H_2SO_4$ |
| 7 | Measurement: | | Wavelength 490 nm/630 nm | |

O/N means overnight.

Figure 4:
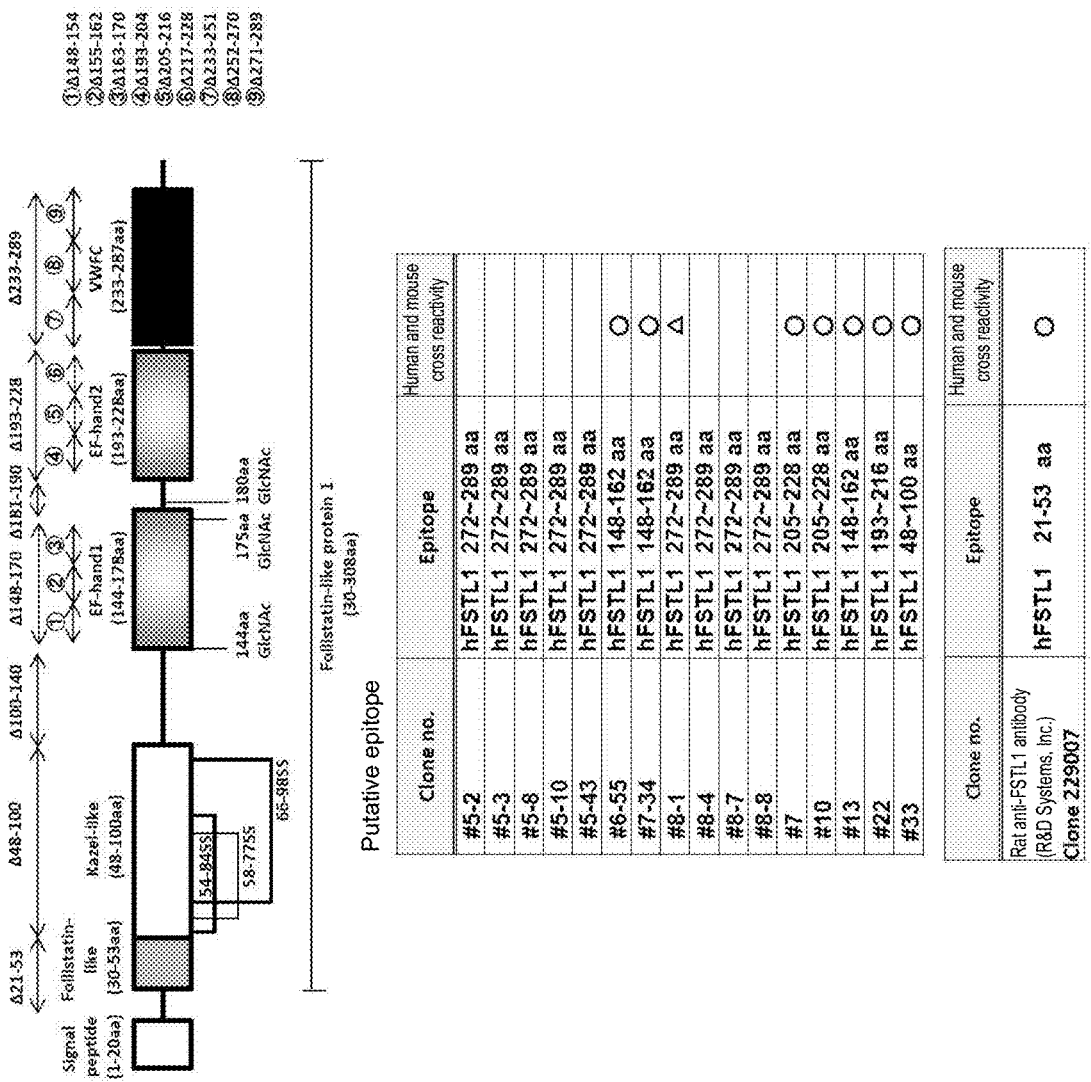
FIG. 4 shows deletion mutants and putative epitopes (Example 3). The upper diagram of FIG. 4 shows a schematic diagram of human FSTL1 and the positions of deletion sites. A putative epitope site for each clone was identified by ELISA using these deletion mutants of human FSTL1 as antigens. The lower diagram of FIG. 4 shows the comparison of putative epitopes between the obtained clones and a rat anti-FSTL1 antibody of R&D Systems, Inc. evaluated in Examples of Patent Literature 1 (WO2009/028411) in a table. Further, clones that exhibit the cross reactivity between humans and mice (strong binding activity: circle, weak binding activity: triangle) are described. As for criteria for strong or weak binding activity, binding activity found for both humans and mice at a concentration of 12.5 ng/ml was classified as "strong", and binding activity found for both humans and mice only at a higher concentration was classified as "weak".

The upper diagram of FIG. 4 shows a schematic diagram of human FSTL1 (with reference to Uniprot, No. Q12841) and the respective deletion sites of the prepared deletion mutants. As a result of the epitope mapping ELISA, the epitope site for each antibody is shown in the lower diagram of FIG. 4. As seen, #5-2, #5-3, #5-8, #5-10, #5-43, #8-1, #8-2, #8-4, and #8-7 were presumed to recognize a sequence contained in the amino acid sequence from positions 233 to 289 as an epitope, and #7, #10, and #22 were presumed to recognize a sequence contained in the amino acid sequence of positions 193 to 228 as an epitope. The epitope for the rat anti-FSLT1 antibody manufactured by R&D Systems, Inc. was predicted as a sequence contained in the amino acid sequence of positions 21 to 53 and thus found to be different from the epitopes for the various antibodies obtained in Example 1. #6-55, #7-34, and #13 were presumed to recognize a sequence contained in the amino acid sequence of positions 148 to 170 as an epitope. Further, these clones were judged as promising antibody clones by in vitro evaluation mentioned later. Therefore, the epitope sequence in the epitope-containing amino acid sequence of 148 to 170 was narrowed down. Specifically, a deletion mutant containing deletion at amino acid positions 148 to 154 (Δ148-154), a deletion mutant containing deletion at amino acid positions 155 to 162 (Δ155-162), and a deletion mutant containing deletion at amino acid positions 163 to 170 (Δ163-170) were prepared and subjected to epitope mapping ELISA in the same way as above. As a result, the epitope sites for #6-55, #7-34, and #13 are shown in the lower diagram of FIG. 4. As seen, these clones were presumed to recognize a sequence contained in the amino acid sequence of positions 148 to 162 as an epitope.

<Further Narrowing Down of Epitope>

The amino acid sequence of positions 148 to 170 (epitope for #6-55, #7-34, and #13), the amino acid sequence of positions 193 to 228 (epitope for #7, #10, and #22), and the amino acid sequence of positions 233 to 289 (epitope for #5-2, #5-3, #5-8, #5-10, #5-43, #8-1, #8-4, #8-7, and #8-8) were further fragmented as deletion sequences, and the epitope sequences were narrowed down. An epitope for clone #33 was identified.

The lower diagram of FIG. 4 reflects summary of these results. The putative epitope for #33 was present in the amino acid sequence of positions 48 to 100. The putative epitope for #7 and #10 was present in the amino acid sequence of positions 205 to 228. The putative epitope for #22 was present in the amino acid sequence of positions 193 to 216. The putative epitope for #5-2, #5-3, #5-10, #5-43, #8-1, #8-4, #8-7, and #8-10 was present in the amino acid sequence of positions 272 to 289.

Example 4: Evaluate of Inhibitory Activity Against Mesenchymal Stem Cell (MSC) Induction In this Example, inhibitory activity against the induction of mesenchymal stem cells (MSCs) by FSTL1 was evaluated.

It is known that when bone marrow cells are stimulated with FSTL1, mesenchymal stem cells (MSCs) having pluripotency or self-proliferative capacity grow (Cancer Research 73: 6185, 2013). Thus, $2 \times 10^7$ cells/well of bone marrow cells collected from the thigh bone of a C57BL/6 mouse were suspended in 3 mL/well of RPMI1640 (GIBCO/Thermo Fisher Scientific Inc., Cat. No. C11875500BT) medium containing 2% fetal bovine serum, supplemented with 50 ng/mL (final concentration) of FSTL1 (R&D Systems, Inc. Cat #1694-FN-050) and 10 μg/mL of the anti-FSTL1 antibody (#5-2, #5-3, #5-8, #5-10, #5-43, #6-55, or #7-34) or its isotype mouse IgG (anti-DNP antibody) as a control antibody "Control", and cultured under stimulation (6-well plate). 11 days thereafter, the number of cells was counted while the cells were stained with a PE-labeled anti-ALCAM antibody (eBioscience, Cat. No. 12-1661-82) and a PE-labeled anti-PDGFRA antibody (eBioscience, Cat #12-1401-81) in order to examine the expression of MSC markers, and the contents of ALCAM-positive cells and PDGFR-positive cells were analyzed by flow cytometry using FACScan (Becton, Dickinson and Company, Code. BECTON-DICKINSON-FACSCAN) to calculate the number of each positive cell per culture. As a result, all of the antibody clones exhibited inhibitory activity against the expansion of ALCAM-positive cells and PDGFRA-positive cells by FSTL1, as compared with the control antibody (anti-DNP antibody). Among them, #5-43, #6-55, and #7-34 exhibited slightly strong tendency of inhibitory activity.

Example 5: Evaluation of Inhibitory Activity Against Activation of Tumor Cell by FSTL1

In this Example, inhibitory activity against the activation of tumor cells by FSTL1 was evaluated.

It is known that tumor cells activated by stimulation with FSTL1 highly express molecule groups promoting bone metastasis and increase metastatic invasive capacity (Cancer Research 73: 6185, 2013). Thus, $2 \times 10^7$ cells/well of a human pancreatic cancer cell line Pancl were suspended in 1 mL/well of D-MEM medium (GIBCO/Thermo Fisher Scientific Inc. Cat. No. C11885500BT) containing 10% fetal bovine serum, supplemented with 50 ng/mL (final concentration) of FSTL1 (R&D Systems, Inc.) and 10 μg/mL of the anti-FSTL1 antibody (#5-2, #5-8, #5-10, #5-43, #6-55, or #7-34) or its isotype mouse IgG (anti-DNP antibody) as a control antibody "Control", and cultured under stimulation (6-well plate). 3 days thereafter, the number of cells was counted while the cells were stained with a PE-labeled anti-RANKL antibody (eBioscience Cat. No. 12-6619) and a PE-labeled anti-CCR2 antibody (R&D Systems, Inc. Cat. No. FAB151P) in order to examine the expression of markers indicating bone metastatic properties, and the contents of RANKL-positive cells and CCR2-positive cells were analyzed by flow cytometry using FACScan (Becton, Dickinson and Company) to calculate the numbers of cells per culture. As a result, all of the antibody clones exhibited inhibitory activity against the expansion of RANKL-positive cells by FSTL1, as compared with the control antibody (anti-DNP antibody). The results of this experiment revealed that when the content of RANKL-positive cells and the number of cells per culture were compared, the number of cells was confirmed to be more appropriate for evaluation. Therefore, in Examples below, judgment was made with the number of cells as an index.

Example 6: Evaluation of Inhibitory Activity Against Induction of Mesenchymal Stem Cell (MSC) by FSTL1

In this Example, the same experiment as in Example 4 was conducted.

Figure 5:
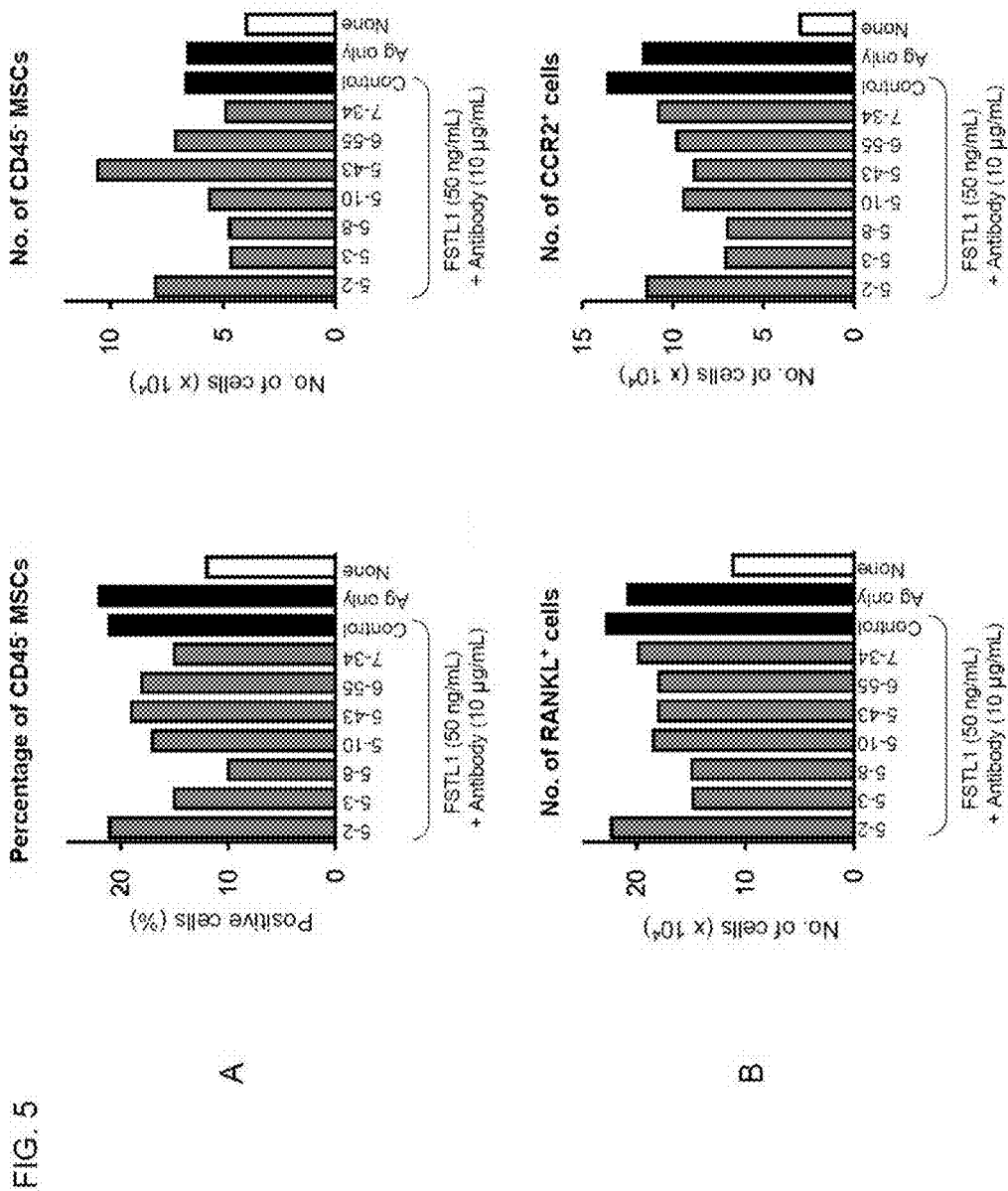
FIG. 5 shows results indicating effects brought about by the suppression of FSTL1 on mesenchymal stem cells (MSCs) and bone metastasis (Examples 6 and 7). Part A shows the influence of antibodies on an effect of inducing mouse bone marrow-derived mesenchymal stem cells by FSTL1 (Example 6). The proportion of mesenchymal stem cell (MSC) marker CD45-negative cells was analyzed by flow cytometry, and the percentage and number of the cells were shown. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity against the action of FSTL1, as compared with the control antibody (anti-DNP antibody). Among them, clone #5-3, #5-8, and #7-34 exhibited higher inhibitory activity and substantially completely inhibited the action of FSTL1. Part B shows the influence of antibodies on an effect of inducing RANKL- and CCR2-positive cells in a human pancreatic cancer cell line Panc1 by FSTL1 (Example 7). The expression of RANKL and CCR2 among molecules known as bone metastasis markers was analyzed by flow cytometry, and the numbers of positive cells were indicated in graphs. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity, as compared with the control antibody (anti-DNP antibody). Particularly, clone #5-3 and #5-8 exhibited higher inhibitory activity.

Mouse bone marrow cells prepared in the same way as in Example 4 were supplemented with 50 ng/mL (final concentration) of FSTL1 and 10 μg/mL of the anti-FSTL1 antibody (#5-2, #5-3, #5-8, #5-10, #5-43, #6-55, or #7-34) or a control antibody anti-DNP antibody and cultured under stimulation. 11 days thereafter, the number of cells was counted while the cells were stained with a PE-Cy5-labeled anti-CD45 antibody (BD Pharmingen/Becton, Dickinson and Company, Cat. No. 555484), and the content of CD45-negative cells reported to generally contain MSCs at a high rate was analyzed by flow cytometry using FACScan to calculate the percentage and number of MSCs per culture (FIG. 5A). As a result, all of the antibody clones exhibited inhibitory activity against the expansion of CD45-negative cells by FSTL1, as compared with the control antibody. Among them, #5-3, #5-8, #7-34, and #5-43 exhibited higher inhibitory activity and substantially completely inhibited the action of FSTL1.

Example 7: Evaluation of Inhibitory Activity Against Activation of Tumor Cell by FSTL1

In this Example, inhibitory activity against the activation of tumor cells by FSTL1 was evaluated in RANKL-positive cells and CCR2-positive cells.

In the same way as in Example 5, a human pancreatic cancer cell line Pancl was supplemented with 50 ng/mL (final concentration) of FSTL1 (R&D Systems, Inc.) and 10 μg/mL of the anti-FSTL1 antibody (the same clones as in Example 6) or a control antibody and cultured under stimulation.

3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 5B). As a result, all of the antibody clones exhibited inhibitory activity against the expansion of RANKL-positive cells and CCR2-positive cells, as compared with the control antibody. Among them, #5-3 and #5-8 exhibited higher inhibitory activity.

Example 8: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated in the same way as in Examples 4 and 6 except that the concentration was changed.

Figure 6A:
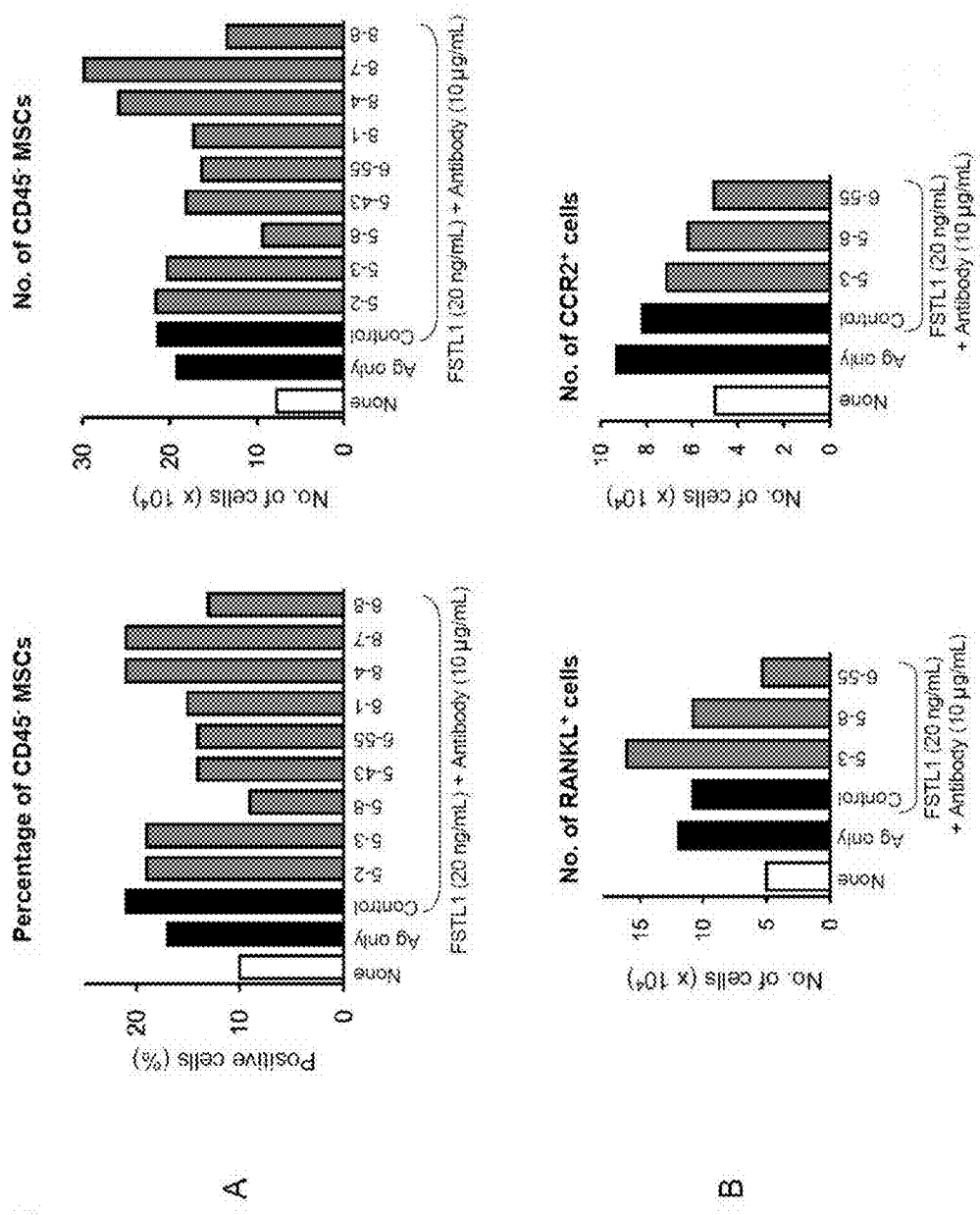
FIG. 6A also shows results indicating effects brought about by the suppression of FSTL1 on mesenchymal stem cells and bone metastasis (Examples 8 to 11). Part A shows the influence of antibodies on an effect of inducing mouse bone marrow-derived mesenchymal stem cells by FSTL1 (Example 8; the FSTL1 concentration was set to a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Inhibitory activity was confirmed in clone #5-8, #5-43, #6-55, #8-1, and #8-8. Part B shows the influence of antibodies on an effect of inducing RANKL- and CCR2-positive cells in a human pancreatic cancer cell line Pancl by FSTL1 (Example 9; the FSTL1 concentration was set to a low concentration of 20 ng/ml). The expression of RANKL and CCR2 among molecules known as bone metastasis markers was analyzed by flow cytometry, and the numbers of positive cells were indicated in graphs. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Clone #5-8 and #6-55 exhibited higher inhibitory activity.

Mouse bone marrow cells prepared in the same way as in Example 4 were supplemented with 20 ng/mL (final concentration) of FSTL1 and 10 μg/mL of the anti-FSTL1 antibody (#5-2, #5-3, #5-8, #5-10, #5-43, #6-55, #8-1, #8-4, #8-7, and #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 6A). As a result, #5-8, #5-43, #6-55, #8-1, and #8-4 exhibited inhibitory activity against the expansion of CD45-negative cells by FSTL1, as compared with the control antibody.

Example 9: Evaluation of Inhibitory Activity Against Activation of Tumor Cell by FSTL1

In this Example, inhibitory activity against the activation of tumor cells by FSTL1 was evaluated at lower concentration.

Figure 6B:
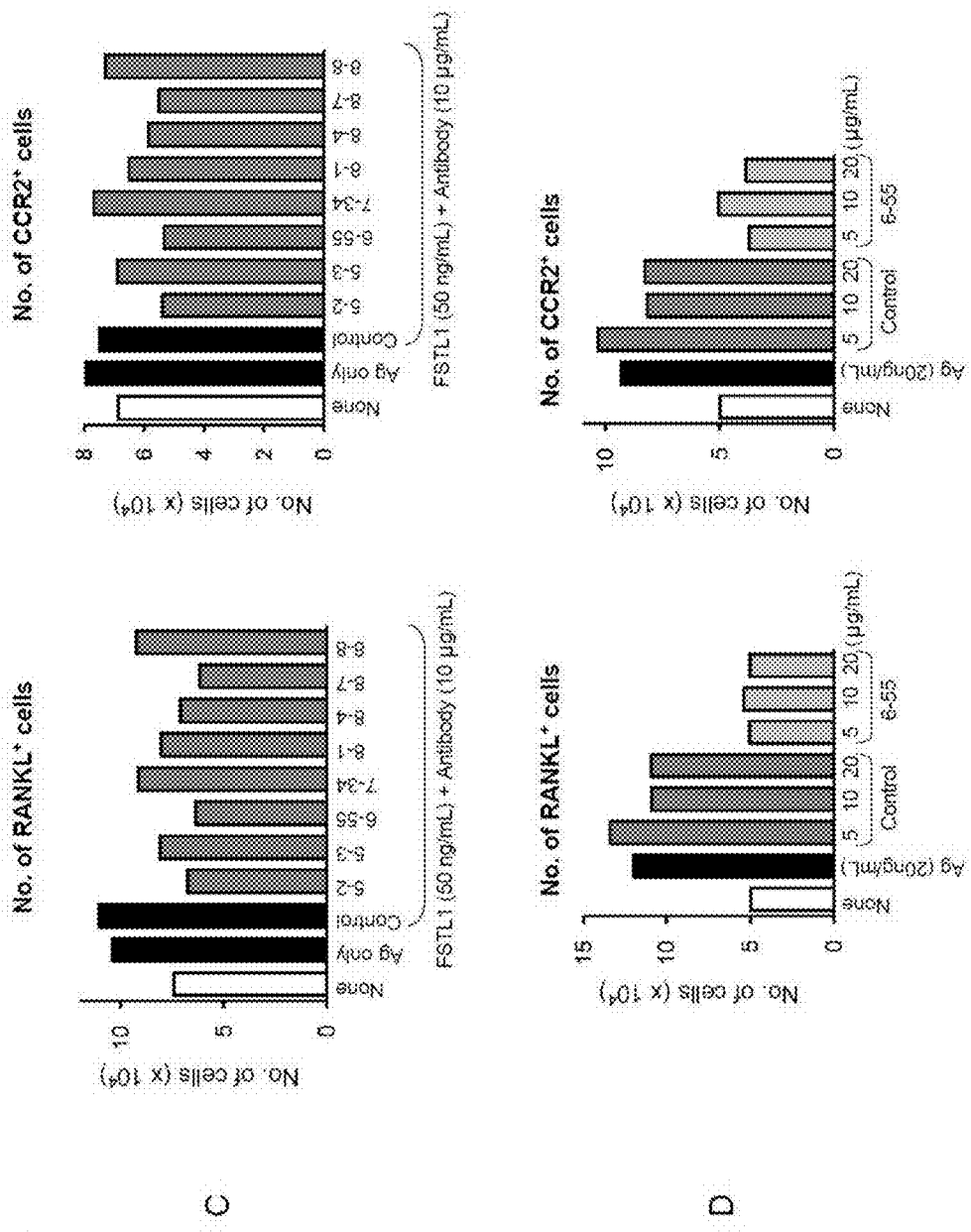
FIG. 6B Part C shows the influence of antibodies on an effect of inducing RANKL- and CCR2-positive cells in a human pancreatic cancer cell line Pancl by FSTL1 (Example 10). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity, as compared with the control antibody (anti-DNP antibody). Particularly, clone #5-2, #6-55, #8-4, and #8-7 exhibited higher inhibitory activity. Part D shows the influence of an antibody on an effect of inducing RANKL- and CCR2-positive cells in a human pancreatic cancer cell line Pancl by FSTL1. Here, an antibody dose dependence test was conducted (Example 11). The expression of RANKL and CCR2 among molecules known as bone metastasis markers was analyzed by flow cytometry, and the numbers of positive cells were indicated in graphs. Clone #6-55 exhibited inhibitory activity, as compared with the control antibody (anti-DNP antibody), though the dose dependence of the antibody was not confirmed. The clone shown in the graphs is depicted on the right bars, a control antibody (anti-DNP antibody) is depicted on the third bar from the left, an antigen alone is depicted on the second bar from the left, and a non-supplemented sample is depicted on the leftmost bar. Clone #6-55 strongly inhibited the cell induction of both RANKL-positive cells and CCR2-positive cells at the same time.

In the same way as in Example 5, a human pancreatic cancer cell line Panc1 was supplemented with 20 ng/mL (final concentration) of FSTL1 and 10 µg/mL of the anti-FSTL1 antibody (#5-2, #5-8, or #6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 6B). As a result, #5-8 and #6-55 also exhibited inhibitory activity against the expansion of RANKL-positive cells and CCR2-positive cells using the concentration of 20 ng/mL (final concentration), as compared with the control antibody.

Example 10: Evaluation of Inhibitory Activity Against Activation of Tumor Cell by FSTL1

In this Example, inhibitory activity against the activation of tumor cells by FSTL1 was evaluated, also including newly obtained clones.

In the same way as in Example 5, a human pancreatic cancer cell line Panc1 was supplemented with 50 ng/mL (final concentration) of FSTL1 and 10 µg/mL of the anti-FSTL1 antibody (#5-2, #5-3, #6-55, #7-34, #8-1, #8-4, #8-7, or #8-8) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, #5-2, #6-55, #8-4, and #8-7 exhibited high inhibitory activity against the expansion of RANKL-positive cells and CCR2-positive cells, as compared with the control antibody (FIG. 6C).

Example 11: Evaluation of Inhibitory Activity Against Activation of Tumor Cell by FSTL1 (Dose Dependence Test)

In this Example, inhibitory activity against the activation of tumor cells by FSTL1 was evaluated at varying doses including a low dose.

In the same way as in Example 5, a human pancreatic cancer cell line Panc1 was supplemented with 50 ng/mL (final concentration) of FSTL1 and 10 µg/mL of the anti-FSTL1 antibody (#6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, the tested #6-55 exhibited substantially 100% inhibitory activity against the expansion of RANKL-positive cells and CCR2-positive cells at all of the tested doses (5 µg/mL, 10 µg/mL, and 20 µg/mL), as compared with the control antibody, though the dose dependence of antibody was not confirmed (FIG. 6D).

Example 12: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated, including further clones.

Figure 7:
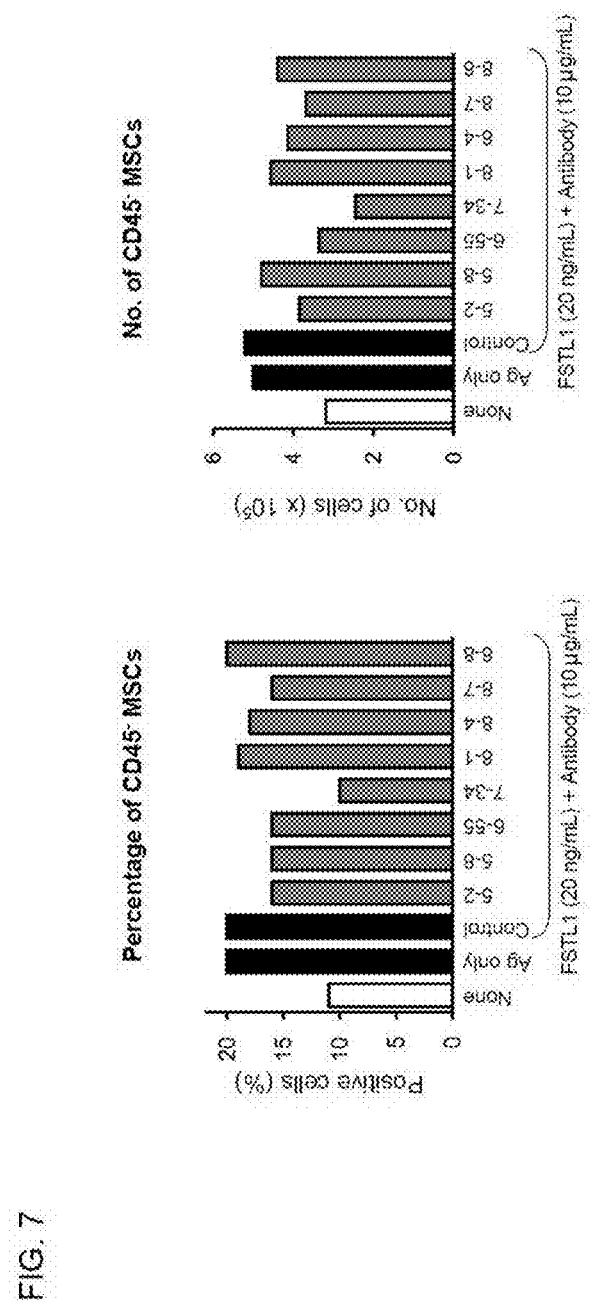
FIG. 7 shows the influence of antibodies on an effect of inducing mouse bone marrow-derived mesenchymal stem cells by FSTL1 (Example 12; the FSTL1 concentration used was a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity against the action of FSTL1, as compared with the control antibody (anti-DNP antibody). Particularly, stronger inhibitory activity was confirmed in the order of clone #7-34, #5-2, #6-55, and #8-7.

Mouse bone marrow cells prepared in the same way as in Example 4 were supplemented with 20 ng/mL (final concentration) of FSTL1 and 10 µg/mL of the anti-FSTL1 antibody (#5-2, #5-8, #6-55, #7-34, #8-1, #8-4, #8-7, or #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 7). As a result, all of the clones exhibited inhibitory activity against the expansion of CD45-negative cells by FSTL1, as compared with the control. Particularly, higher inhibitory activity was confirmed in the order of #7-34, #5-2, #6-55, and #8-7.

<Example 13: Evaluation of Inhibitory Activity Against Induction of Mesenchymal Stem Cell (MSC), Cancer-Associated MSC, and Myeloid-Derived Suppressor Cell (MDSC) by FSTL1>

In this Example, inhibitory activity against the induction of mesenchymal stem cells (MSC), cancer-associated MSCs, and myeloid-derived suppressor cells (MDSCs) by FSTL1 was evaluated.

Figure 8:
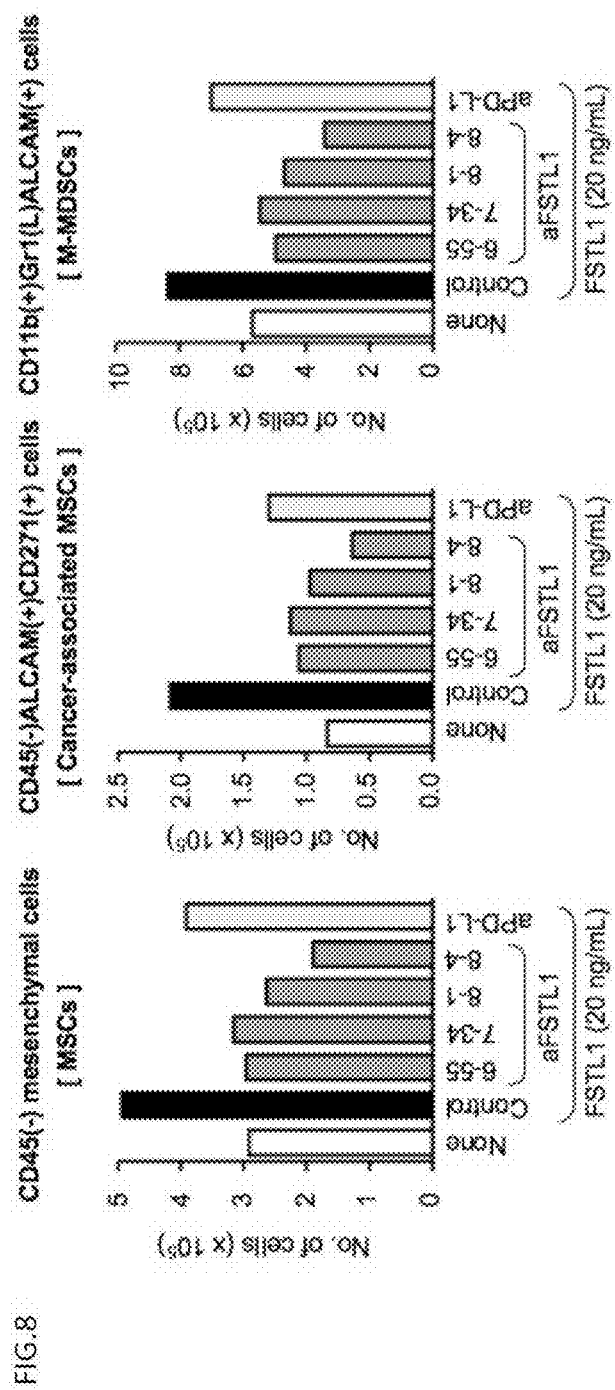
FIG. 8 shows results of evaluating the activity of anti-FSTL1 antibodies and an anti-ED-Li antibody produced for in vivo (Example 13). Mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody is depicted in the second bar from the left, the anti-PD-L1 antibody is depicted in the rightmost bar, and intermediate 4 clones respectively represent the anti-FSTL1 antibodies. These antibodies produced for in vivo were found to be appropriate antibodies because all of the antibodies exhibited high inhibitory activity, as in the results mentioned above, as compared with the control antibody. PD-L1 is expressed in MSCs and presumably influences the induction of MSCs. However, inhibitory activity was found to be stronger in the anti-FSTL1 antibodies.

Mouse bone marrow cells prepared in the same way as in Example 4 were supplemented with 20 ng/mL (final concentration) of FSTL1 and 10 µg/mL of the anti-FSTL1 antibody (#6-55, #7-34, #8-1, or #8-4), an anti-PD-L1 antibody reported to have an immunosuppression-mitigating effect, or a control antibody anti-DNP antibody and cultured under stimulation. 8 days thereafter, the number of cells was counted while the cells were stained with a PE-Cy5-labeled anti-CD45 antibody, a PE-labeled anti-ALCAM antibody, a FITC-labeled anti-CD271 antibody (Abcam plc, Cat. No. AB62122), a FITC-labeled anti-CD11b antibody (BD Pharmingen/Becton, Dickinson and Company, Cat. No. 553310), and a PE-Cy5-labeled anti-Gr1 antibody (eBioscience, Cat. No. 15-5931) in order to detect MSCs (CD45-negative cells), cancer-associated MSCs (CD45-negative, ALCAM-positive, and CD271-positive cells) which are MSCs increasing in number in association with cancer metastasis, and monocytic myeloid-derived suppressor cells (M-MDSCs: CD11b-positive, Gr1-positive, and ALCAM-positive cells) increasing in number together with cancer-associated MSCs, and the contents of the cells mentioned above were analyzed by flow cytometry using FACScan to calculate the percentage and number of MSCs per culture (FIG. 8). As a result, all of the clones exhibited high inhibitory activity against the induction of MSCs, cancer-associated MSCs, and M-MDSCs by FSTL1, as compared with the control antibody. PD-L1 is expressed in MSC and presumably influences the induction of MSCs. However, inhibitory activity was found to be stronger in the anti-FSTL1 antibodies.

Example 14: Evaluation of Inhibitory Activity Against Induction of Mesenchymal Stem Cell (MSC), Cancer-Associated MSC, and Myeloid-Derived Suppressor Cell (MDSC) by FSTL1, and Evaluation of Ability to Differentiate into Adipocyte)

In this Example, inhibitory activity against the induction of mesenchymal stem cells (MSCs), cancer-associated MSCs, and myeloid-derived suppressor cells (MDSCs) by FSTL1 was evaluated.

The antibody clone (#6-55, #7, #10, #13, or #22) was evaluated for its activity by the same testing method as in Example 13. #6-55 was set as a positive control for activity. As a result, all of the clones exhibited inhibitory activity against the induction of MSCs, cancer-associated MSCs, and M-MDSCs by FSTL1, as compared with the control antibody. Among them, #13 exhibited inhibitory activity equivalent to or higher than that of the positive control (FIG. 9A). These results seem to be reasonable because epitopes for #13 and #6-55 are the same regions. FIG. 9B shows results of analyzing inhibitory activity against the induction of MSCs having the ability to differentiate into adipocytes. Mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation. In the graph, none is depicted in the leftmost bar, and the control antibody is depicted in the second bar from the left followed by the anti-FSLT1 antibody clones. Adipocytes were not confirmed for any of the anti-FSLT1 antibodies. It is understood that the differentiation induction of MSCs serving as the original source is inhibited.

Example 15: Comparison with Conventional Antibody

In this Example, activity was compared with an anti-FSTL1 antibody (manufactured by R&D Systems, Inc.) evaluated in Examples of Patent Literature 1 (WO2009/028411).

FSTL1 inhibitory activity was compared between the rat anti-FSTL1 antibody of R&D Systems, Inc. (Cat. No. MAB1694, clone 229007) found in Patent Literature 1 (WO2009/028411) to exhibit inhibitory activity against the induction of regulatory T cells important for immunosuppression, and #6-55 of the present invention.

Mouse bone marrow cells (bone marrow cells prepared in the same way as in Example 4) were supplemented with 20 ng/mL (final concentration) of FSTL1 and 20.0, 10.0, 5.0, or 2.5 μg/ml (final concentration) of the rat anti-FSTL1 antibody or #6-55. Also, mouse bone marrow cells were supplemented with 20.0 μg/ml (final concentration) each of their respective control antibodies, a rat IgG2b isotype control (R&D Systems, Inc., Cat. No. MAB0061, clone 141945) and an anti-DNP antibody. The cells were cultured for 8 days, and the inhibitory activity of each antibody against the induction of MSCs, cancer-associated MSCs, and M-MDSCs by FSTL1 was evaluated in the same way as in Example 13 (FIG. 10A). As a result, the inhibitory activity of the rat anti-FSTL1 antibody and the antibody of #6-55 was at the same level. On the other hand, dose dependence was not confirmed. The inhibition of regulatory T cells shown in Patent Literature 1 (WO2009/028411) is presumably a consequence mediated by the inhibition of MSC induction.

Example 16: Evaluation of Inhibitory Activity Against Induction of Mesenchymal Stem Cell (MSC) by FSTL1 (Evaluation of Ability to Differentiate into Adipocyte)

In this Example, the ability to differentiate into adipocytes was evaluated in order to evaluate inhibitory activity against an effect of inducing mesenchymal stem cell (MSC)-mediated immunosuppression by FSTL1.

In the same way as in Example 15, mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation (FIG. 10B). As a result, cells differentiating into adipocytes decreased in number by the addition of #6-55 in a dose-dependent manner, as compared with the anti-DNP antibody (mouse IgG control group). On the other hand, in the case of adding the rat anti-FSTL1 antibody of R&D Systems, Inc., no influence was confirmed on differentiation into adipocytes, and a large number of adipocytes were observed at all of the doses, as in the rat IgG2b isotype control group. Specifically, not all of cells in a CD45-negative cell population are MSCs, and this population is merely a cell population containing MSCs at a high rate. It was shown that although the CD45-negative cells decreased in number by the rat anti-FSTL1 antibody of R&D Systems, Inc., there still remained many MSCs differentiating into adipocytes.

Example 17: In Vivo Antibody Activity Evaluation-Intratumoral Administration

In this Example, the drug efficacy of the anti-FSTL1 antibody was evaluated by intratumoral administration using bone metastasis models having a transplant of mouse melanoma B16-F10 cells forced to express Snail.
<Method and Material>
Three antibodies were comparatively analyzed for their antitumor effects and an immunosuppression-mitigating effect using bone metastasis models in which mouse melanoma cells B16-F10 forced to express Snail were subcutaneously and intravenously transplanted in C57BL/6N mice.
1. Experiment group (n=5)
1. No treatment
2. Control IgG (anti-DNP)
3. Anti-FSTL1 Clone #6-55
4. Anti-FSTL1 Clone #7-34
5. Anti-FSTL1 Clone #8-1

Figure 11A:
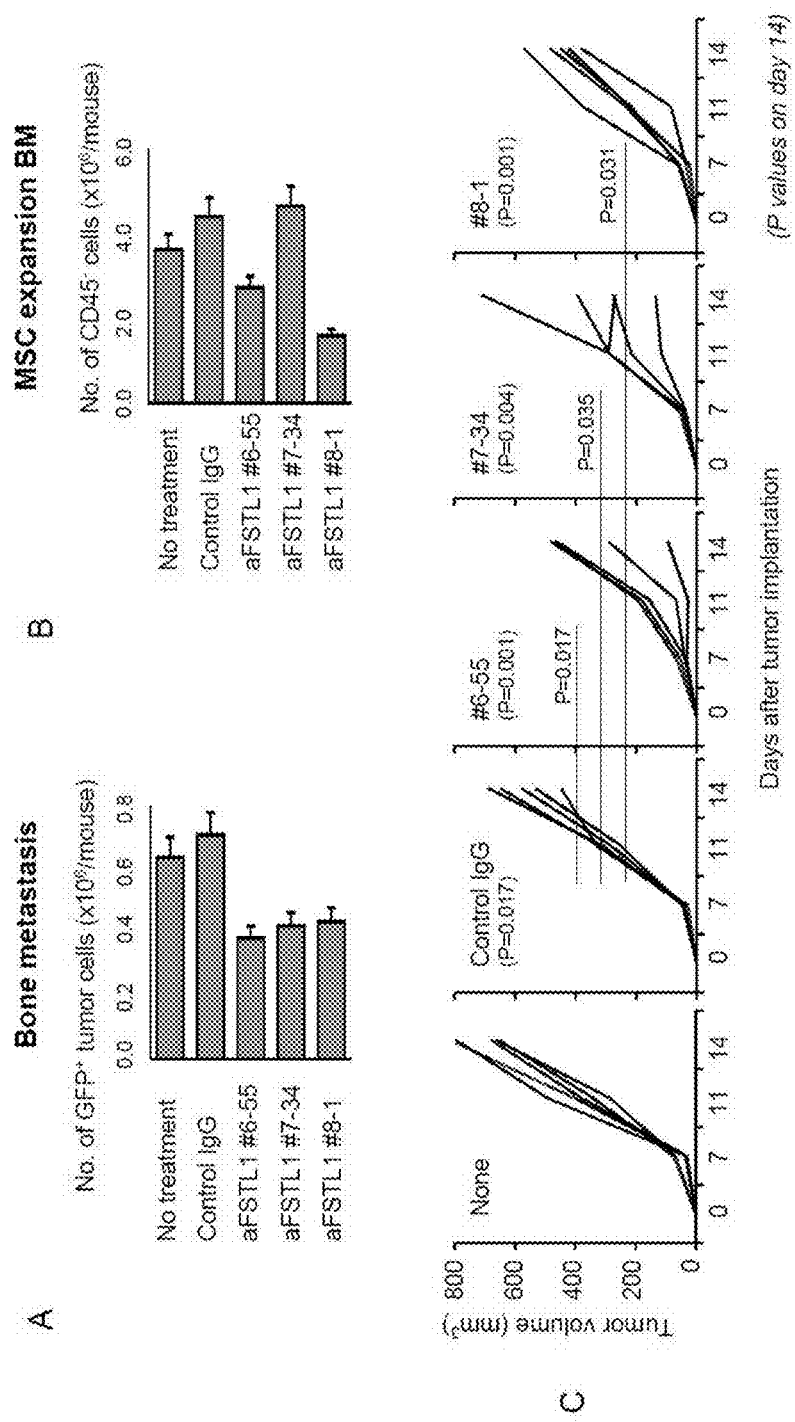
FIG. 11A shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5\times10^5$ cells subcutaneously & $1\times10^5$ cells intravenously) were transplanted. On day 7, the antibody was administered into subcutaneous tumor (200 μg/0.1 mL/tumor). On day 14, various assays were conducted. Part A (the number of tumor cells that metastasized into bone marrow) shows results of analyzing the percentage (%) of GFP-positive tumor cells in bone marrow cells by flow cytometry and then counting the number of GFP-positive tumor cells ($\times10^6$ cells) per mouse on the basis of this data, and shows the effects of various antibodies on bone metastasis (bone metastasis was suppressed). Part B (the number of CD45-negative cells in bone marrow) shows results of analyzing the percentage (%) of CD45-negative cells in bone marrow cells by flow cytometry and then counting the number of CD45-negative bone marrow cells ($\times10^6$ cells) per mouse on the basis of this data, and shows the effects of various antibodies on MSC expansion in bone marrow (MSC expansion in bone marrow was suppressed). In both bar graphs, groups respectively receiving no treatment, a control antibody, clone #6-55, #7-34, and #8-1 are depicted from the upper to lower bars. Part C (tumor volume of each mouse individual) shows the tumor volume of each mouse individual (one line represents one mouse) measured 7, 11, and 14 days after tumor implantation, and shows the effects of various antibodies on tumor growth (subcutaneously transplanted tumor growth was suppressed). Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34.

2. Experimental procedure
Day 0: transplantation of GFP-positive and Snail-positive B16-F10 tumor cells (5×10$^5$ cells subcutaneously & 1×10$^5$ cells intravenously)
Day 7: intratumoral administration of the antibody (200 µg/0.1 mL/tumor)
Day 14: various assays (with a focus on flow cytometry analysis)
3. Index for drug efficacy evaluation
  Effects on the growth of subcutaneous tumor (calculation of tumor volume by tumor size measurement): measured 7, 11, and 14 days after tumor implantation (FIG. 11C)
  Effects on bone metastasis (GFP-positive tumor cells in bone marrow) (FIG. 11A)
  Effects on the expansion of mesenchymal stem cells (CD45-negative cells in bone marrow and in the spleen) (FIGS. 11B and 11D)
  Effects on the expansion of immunosuppressive Treg cells (CD4-positive and Foxp3-positive cells in bone marrow or the spleen) (FIG. 11D)
  Other immunosuppressive properties (FIG. 11D)

DESCRIPTION

In order to evaluate in vivo antibody activity, antitumor effects and immunosuppression-mitigating effects were comparatively analyzed using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells (5×10$^5$ cells subcutaneously & 1×10$^5$ cells intravenously) were transplanted. On day 7, the antibody was administered into subcutaneous tumor (200 µg/0.1 mL/tumor). On day 14, various assays were conducted.

Figure 11B:
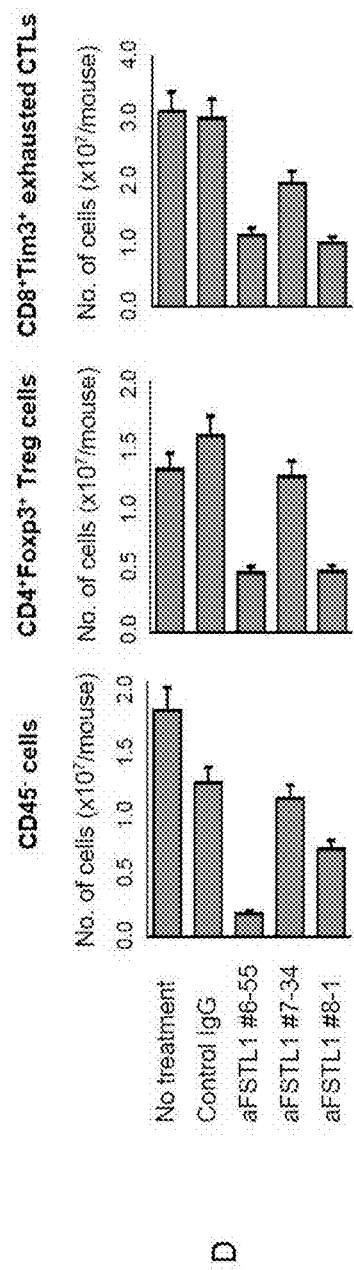
FIG. 11B shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5\times10^5$ cells subcutaneously & $1\times10^5$ cells intravenously) were transplanted. On day 7, the antibody was administered into subcutaneous tumor (200 μg/0.1 mL/tumor). On day 14, various assays were conducted. Part D shows change in cell populations in the spleen. As presented, even if an antibody is administered locally, for example, into tumor, the whole body receives modification or influence. The left graph shows the number of CD45-negative cells and shows that MSCs also decrease in number in the spleen. The middle graph shows the number of CD4-positive and Foxp3-positive T cells and shows that Tregs decrease in number. The right graph shows the number of CD8-positive and Tim3-positive T cells and shows that exhausted CD8-positive T cells decrease in number. In this context, the exhaustion refers to a state having functional decline or dysfunction. Tim3 is a marker that reflects the state. If CD8-positive T cells supposed to kill tumor cells fall into an exhausted state, cancer cells cannot be eliminated from the living body.

It is known that when Snail-positive tumor cells are subcutaneously or intravenously transplanted to mice, the tumor metastasizes preferentially to bone marrow in addition to various organs, and this incurs the expansion of mesenchymal stem cells (MSCs) originating in the bone marrow, thereby systemically and strongly suppressing the induction of antitumor immunity (Cancer Research 73: 6185, 2013). Thus, GFP-positive and Snail-positive B16-F10 tumor cells forced to express GFP and Snail by the transfer of the GFP gene and the mouse Snail gene were transplanted subcutaneously (5×10$^5$ cells) and into the tail vein (1×10$^5$ cells). 7 days thereafter, 10 mg/kg of the anti-FSTL1 antibody (#6-55, #7-34, or #8-1) or its isotype control antibody mouse IgG (anti-DNP antibody) adjusted to 1 mg/ml with saline was inoculated into tumor (5 mice/group). First, subcutaneous tumor size was measured before assays, and the tumor volume was calculated to evaluate an inhibitory effect on subcutaneous tumor growth (FIG. 11C (change of each individual is shown)). 7 days after antibody administration (14 days after tumor implantation), bone marrow cells or spleen cells were collected from the mice, and the number of cells per mouse was counted while drug efficacy was comparatively analyzed in more detail by flow cytometry analysis using FACScan (Becton, Dickinson and Company). Specifically, a) the content of GFP-positive and Snail-positive B16-F10 tumor cells in the bone marrow cells was analyzed to evaluate an inhibitory effect on bone metastasis (FIG. 11A). The percentage (%) of CD45$^-$ cells in the bone marrow cells was analyzed by flow cytometry. Then, the number of CD45-negative bone marrow cells (×10$^6$ cells) per mouse was counted on the basis of this data (FIG. 11B). The effects of various antibodies on MSC expansion in bone marrow are shown. b) The content of CD45-negative cells in the spleen was analyzed (PE-Cy5-labeled anti-CD45 antibody, Becton, Dickinson and Company) to evaluate an inhibitory effect on MSC expansion (left graph of FIG. 11D). c) The contents of immunosuppressive CD4-positive and Foxp3-positive cells (PE-labeled anti-CD4 antibody, Becton, Dickinson and Company; FITC-labeled anti-Foxp3 antibody, eBioscience) (middle graph of FIG. 11D) which are reportedly induced by MSCs, and CD8-positive and Tim3-positive T cells (CyChrome-labeled anti-CD8 antibody, Becton, Dickinson and Company; FITC-labeled anti-Tim3 antibody, R&D Systems, Inc.) exhausted to fall into dysfunction (right graph of FIG. 11D) were analyzed in bone marrow or the spleen to evaluate an immunosuppression-mitigating effect.

(Results)

The results are shown in FIG. 11. Antitumor effects and immunosuppression-mitigating effects, etc. were comparatively analyzed using bone metastasis models in which mouse melanoma cells (B16-F10) forced to express Snail were subcutaneously and intravenously transplanted in C57BL/6N mice. Intratumoral administration was performed as a method for administering the anti-FSTL1 antibody to be tested. All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34. FIG. 11D shows change in cell populations in the spleen. As shown, even if an antibody is administered locally, for example, into tumor, the whole body receives modification or influence. The left graph of FIG. 11D shows the number of CD45-negative cells and shows that MSCs also decrease in number in the spleen. The middle graph of FIG. 11D shows that CD4-positive and Foxp3-positive T cells decrease in number and shows that Tregs (regulatory T cells) decrease in number. The right graph of FIG. 11D shows the number of CD8-positive and Tim3-positive T cells and demonstrated that exhausted CD8-positive T cells decrease in number. In this context, the "exhaustion" refers to a state having functional decline or dysfunction. Tim3 is a marker that reflects the state. If CD8-positive T cells supposed to kill tumor cells fall into an exhausted state, cancer cells cannot be eliminated from the living body. Thus, it can be concluded that the effects of the present invention exhibit remarkable effects of suppressing the enhancement of such immunosuppression.

Example 18: In Vivo Antibody Activity Evaluation-Intraperitoneal Administration

In this Example, the drug efficacy of the anti-FSTL1 antibody was evaluated by systemic administration (intraperitoneal administration) using bone metastasis models having a transplant of mouse melanoma B16-F10 cells forced to express Snail.
1. Experiment group (n=5)
1. No treatment (0.9% NaCl as a sham)
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells (5×105 cells subcutaneously & 1×105 cells intravenously)

Day 5: intraperitoneal administration of the antibody (first dose, corresponding to 200 μg/mouse=10 mg/kg)
Day 10: intraperitoneal administration of the antibody (second dose, corresponding to 200 μg/mouse=10 mg/kg)
Day 14: various immunological assays The intraperitoneal administration and the intravenous administration are pharmacologically used interchangeably with systemic administration methods.

3. Index for drug efficacy evaluation

Figure 12A:
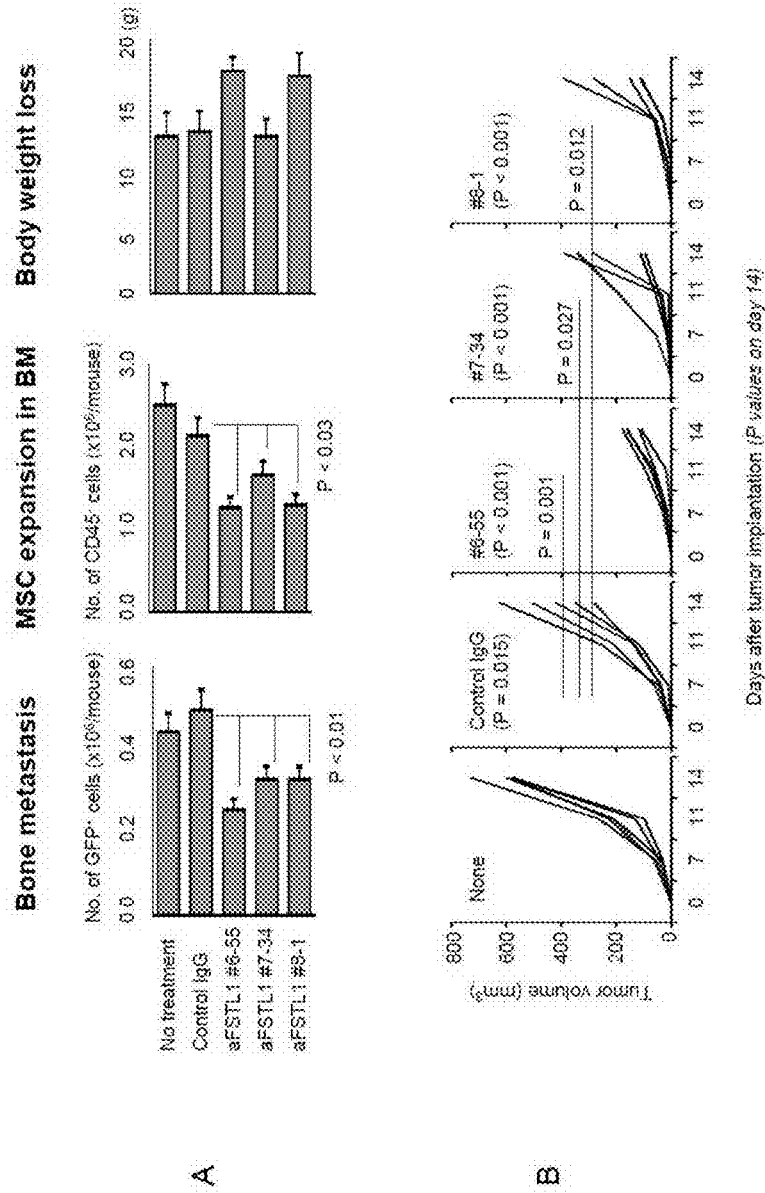
FIG. 12A also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5 \times 10^5$ cells subcutaneously & $1 \times 10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. The left graph of part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). The middle graph of part A (the number of CD45-negative cells in bone marrow) shows results of analyzing the percentage (%) of CD45– cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). The right graph of part A (mouse body weight) shows effects on weight change (although a mouse is emaciated by bone metastasis, this was found to be suppressed as a result of measuring the body weight as an index thereof). In the bar graphs of part A, groups respectively receiving no treatment, a control antibody, clone #6-55, #7-34, and #8-1 are depicted from the upper to lower bars. Five graphs of part B show the tumor volume of each mouse individual (one line represents one mouse) measured 7, 11, and 14 days after tumor implantation, and show the effects of various antibodies on tumor growth. Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies to be tested significantly suppressed the growth of subcutaneous tumor with respect to the control antibody. In addition, an anti-weight loss effect was confirmed by the administration of #6-55 and #8-1.
Figure 12B:
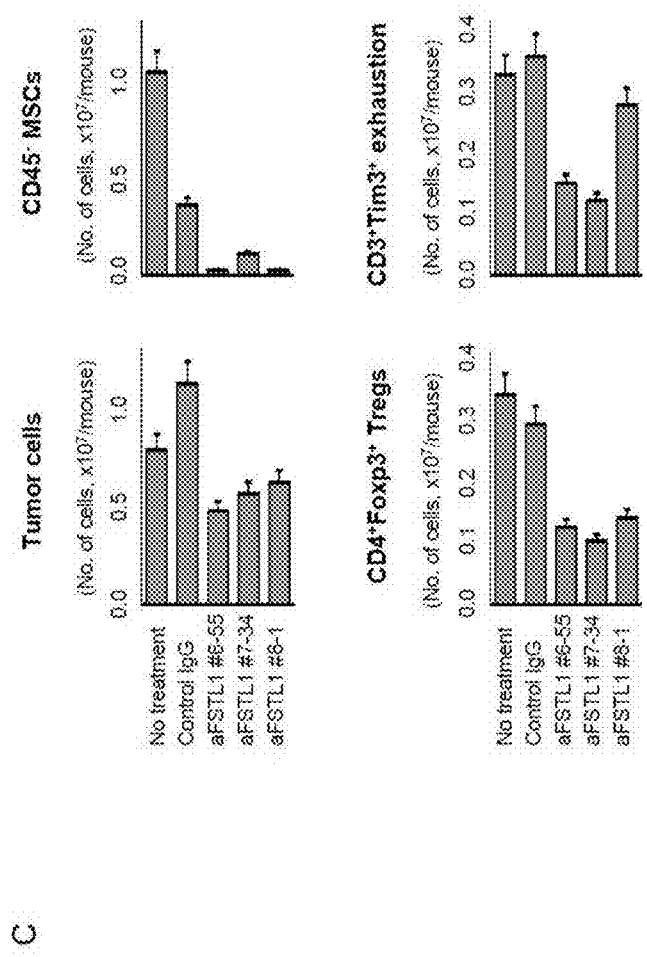
FIG. 12B also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5 \times 10^5$ cells subcutaneously & $1 \times 10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. Part C shows change in cell populations in the spleen. The upper left graph of part C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Effects on the growth of subcutaneous tumor (calculation of tumor volume by tumor size measurement): measured 7, 11, and 14 days after tumor implantation (FIG. 12B)

Effects on bone metastasis (GFP-positive tumor cells in bone marrow or the spleen) (FIGS. 12A and 12C)

Effects on MSC expansion (CD45-negative cells in bone marrow or the spleen) (FIGS. 12A and 12C)

Effects on weight loss (FIG. 12A)

Effects on the expansion of immunosuppressive Treg cells (CD4-positive and Foxp3-positive cells in the spleen) (FIG. 12C)

Other immunosuppressive properties (FIG. 12C)

DESCRIPTION

In Example 17, the antibody was administered into tumor according to the purpose of "inhibiting metastasis from a primary focus to bone" as previously conducted by the present inventors. In this Example, the conditions of Example 17 were changed, and intraperitoneal administration generally performed in mouse experiments was adopted in consideration of the fact that antibody drugs are systemically administered in general. All procedures except for the antibody administration method were performed in the same way as in Example 17 above. Specifically, antitumor effects and immunosuppression-mitigating effects were comparatively analyzed by the intraperitoneal administration (systemic administration) of the anti-FSTL1 antibody using bone metastasis models in which mouse melanoma cells (B16-F10) forced to express Snail were subcutaneously and intravenously transplanted in C57BL/6N mice.

Also, assays were conducted 14 days after tumor implantation. The antibody was intraperitoneally administered at 10 mg/kg twice (5 and 10 days after tumor implantation) to the mice.

(Results)

The results are shown in FIG. 12. Intraperitoneal administration was performed as a method for administering the anti-FSTL1 antibody to be tested here. In in vivo evaluation, as in Example 17, all of the 3 anti-FSTL1 antibodies significantly suppressed the growth of subcutaneous tumor with respect to the control antibody (FIG. 12B). In addition, an anti-weight loss effect (right graph of FIG. 12A) was confirmed by the administration of #6-55 and #8-1. In light of these functional analysis results, even decrease in the number of Tregs, which has heretofore received attention in terms of immunosuppression, or the removal of the Tregs is not sufficient treatment for cancer treatment. Instead, the control of the whole immunosuppression cascade should be contemplated. It is expected that the targeting of MSCs positioned most upstream thereof is more effective. It can also be reconfirmed that the inhibition of even cancer metastasis (middle graph of FIG. 12A) at the same time with decrease in the number of MSCs (left graph of FIG. 12A) is further effective. The possibility is expected that inhibitory treatment targeting FSTL1 is effective for cancer treatment. FIG. 12C shows change in cell populations in the spleen.

The upper left graph of FIG. 12C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Example 19: In Vivo Antibody Activity Evaluation-Comparison with Existing Drug

In this Example, drug efficacy was compared between existing antibody drugs for mitigation of immunosuppression and the anti-FSTL1 antibody using bone metastasis models having a transplant of mouse melanoma B16-F10 cells forced to express Snail.

DESCRIPTION

Procedures and methods of the experiment were substantially the same as in Examples 17 and 18, and assays were conducted 15 days after tumor implantation.

An antibody given below was intraperitoneally administered as an existing drug at 10 mg/kg (200 μg/mouse) twice (4 and 8 days after tumor implantation) to the mice.

In this Example, therapeutic effects were comparatively studied using antibody drugs already clinically used for the purpose of "mitigation of immunosuppression", which is one mechanism of action of the anti-FSTL1 antibody, and Snail-positive tumor bone metastasis models. The antibody was systemically administered twice, as in the preceding test, according to general animal tests using antibody drugs.

1 Experiment group (n=5)
1 No treatment (0.9% NaCl as a sham)
2 Control IgG (anti-DNP)
3 Anti-FSTL1 mAb (#6-55)
4 Anti-CTLA4 mAb (Clone 9H10, BioLegend)
5 Anti-PD-1 mAb (Clone 29F.1A12, BioLegend)
6 Anti-PD-L1 mAb (Clone 10F.9G2, BioLegend)
7 Naive (no tumors, no treatment)
2 Experimental procedure
Day 0: transplantation of GFP-positive and Snail-positive B16-F10 tumor cells ($5 \times 10^5$ cells subcutaneously & $1 \times 10^5$ cells intravenously)
Day 4: intraperitoneal administration of the antibody (first dose, corresponding to 200 μg/mouse=10 mg/kg)
Day 8: intraperitoneal administration of the antibody (second dose, corresponding to 200 μg/mouse=10 mg/kg) Day 15: various assays
3. Index for drug efficacy evaluation Effects on the growth of subcutaneous tumor (calculation of tumor volume by tumor size measurement): measured 8, 11, and 14 days after tumor implantation (FIG. 13A)

Effects on bone metastasis (amount of GFP-positive tumor cells in bone marrow) (FIG. 13B)

Effects on MSC expansion in bone marrow (FIG. 13B)

Effects on weight loss (FIG. 13B)

(Results)

Figure 13:
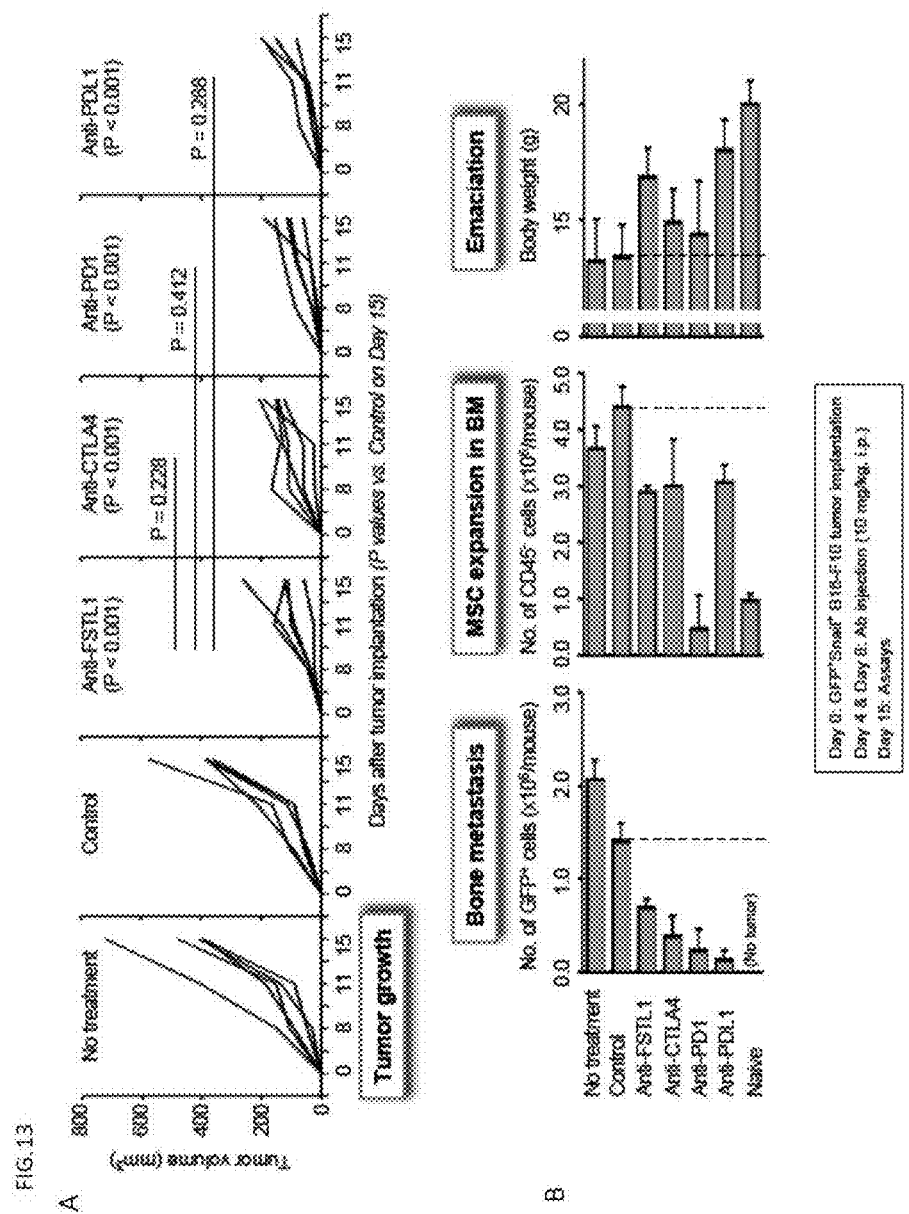
FIG. 13 also shows results of evaluating antibody activity in vivo (Example 19). This figure shows results of comparing drug efficacy between existing antibody drugs for mitigation of immunosuppression and an anti-FSTL1 antibody using bone metastasis models having a transplant of mouse melanoma B16-F10 cells forced to express Snail. Part A shows the effects of various antibodies on tumor volume over time. This figure shows the tumor volume of each mouse individual (one line represents one mouse) measured 8, 11, and 15 days after tumor implantation, and shows the effects of various antibodies on tumor growth. No treatment, a control antibody, an anti-FSTL1 antibody, an anti-CTLA4 antibody, an anti-PD-1 antibody, and an anti-PD-L1 antibody are depicted from the left to the right. The numerical values within the parentheses and the numerical values on the lines (indicated by P) represent p values regarding statistical significance (day 15). The abscissa shows the number of days. The ordinate shows tumor volume (mm$^3$). On day 0, GFP-positive and Snail-positive B16-F10 tumor cells were transplanted ($5 \times 10^5$ cells subcutaneously & $1 \times 10^5$ cells intravenously). On day 4, the antibody was intraperitoneally administered (first dose, corresponding to 200 µg/mouse=10 mg/kg). On day 8, the antibody was intraperitoneally administered (second dose, corresponding to 200 µg/mouse=10 mg/kg). On day 15, various assays were conducted. The left graph of part B shows effects on bone metastasis (the number of GFP-positive cells ($10^6$/mouse)). The middle graph of part B shows effects on MSC expansion in bone marrow (the number of CD45-negative cells (($10^6$/mouse)). The right graph of part B shows effects on weight change (body weight (g)). All of the graphs of part B depict no treatment, a control antibody, an anti-FSTL1 antibody, an anti-CTLA4 antibody, an anti-PD-1 antibody, and an anti-PD-L1 antibody from the upper to lower bars. The following existing antibody drugs were used as control antibodies: Anti-CTLA4 mAb (clone 9H10, BioLegend, Inc.); Anti-PD-1 mAb (clone 29F.1A12, BioLegend, Inc.); and Anti-PD-L1 mAb (clone 10F.9G2, BioLegend, Inc.). In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

The results are shown in FIG. 13. In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Example 20: In Vivo Antibody Activity Evaluation-Colorectal Cancer Model

In this Example, the drug efficacy of the anti-FSTL1 antibody was evaluated using mouse colorectal cancer CT26 cell-transplanted models.

Procedures and methods of the experiment were basically performed under substantially the same conditions as in the bone metastasis model experiments of Examples 17 to 19 except that bone metastasis was not evaluated. Specifically, drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The test was conducted by changing only the amount of tumor implanted, antibody administration timing, and assay timing.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth (FIG. 14A) and lung metastasis (FIG. 14B))

For lung metastasis, the number of metastatic nodules in the lung was macroscopically counted. The tumor volumes of the mice were measured 7, 11, and 14 days after tumor implantation.

(Results)

Figures 14A, 14B:
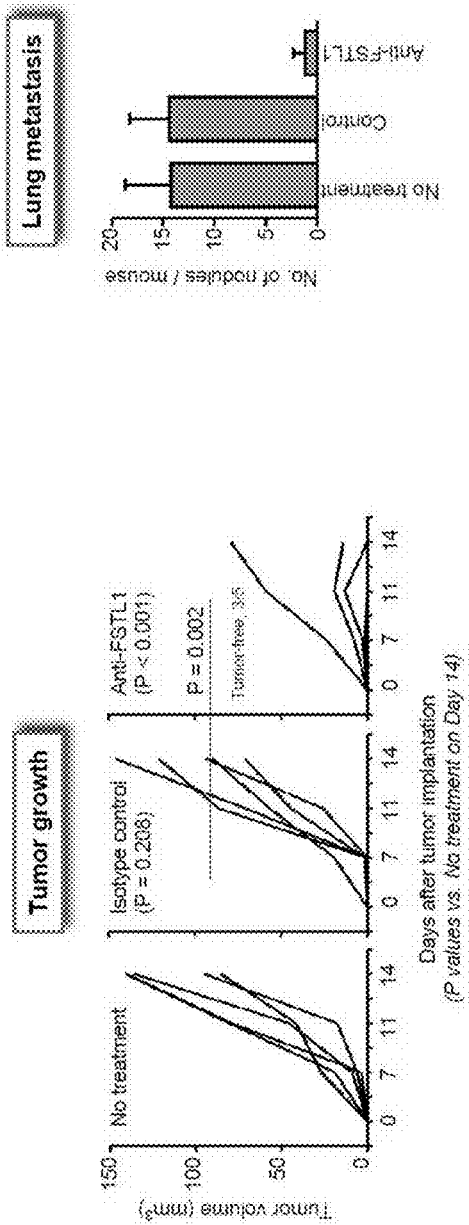
FIG. 14 also shows results of evaluating antibody activity in vivo (Example 20). This figure shows results of evaluating the drug efficacy of an anti-FSTL1 antibody using mouse colorectal cancer CT26 cell-transplanted models. All of the 3 graphs of part A show effects on tumor growth. This figure shows the tumor volume of each mouse individual (one line represents one mouse) measured 7, 11, and 14 days after tumor implantation, and shows the effects of various antibodies on tumor growth. The left graph depicts no treatment, the middle graph depicts a control antibody (anti-DNP antibody), and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm3). Drug efficacy evaluation was conducted using mouse tumor models other than Snail+ tumor bone metastasis models. In this Example, the drug efficacy of the anti-FSTL1 antibody was evaluated using cancer-bearing models of BALB/c mice different in strain from the C57BL/6 mice used in the preceding tests. Part B shows results about the number of metastatic nodules in the lung. The left bar depicts no treatment, the middle bar depicts a control antibody (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

The results are shown in FIG. 14. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The results about the number of metastatic nodules in the lung are shown in FIG. 14B. The left bar depicts no treatment, the middle bar depicts an isotype control (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

Example 21: In Vivo Antibody Activity Evaluation-Breast Cancer Model

In this Example, the drug efficacy of the anti-FSTL1 antibody was evaluated using mouse breast cancer 4T1 cell-transplanted models.

Procedures and methods of the experiment were basically performed according to Examples 17 to 20 under substantially the same conditions as in the bone metastasis model experiments of Examples 17 to 20. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. Changes were made as follows.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth)

The tumor volumes of the mice were measured 4, 7, 11, and 14 days after tumor implantation.

(Results)

Figure 15:
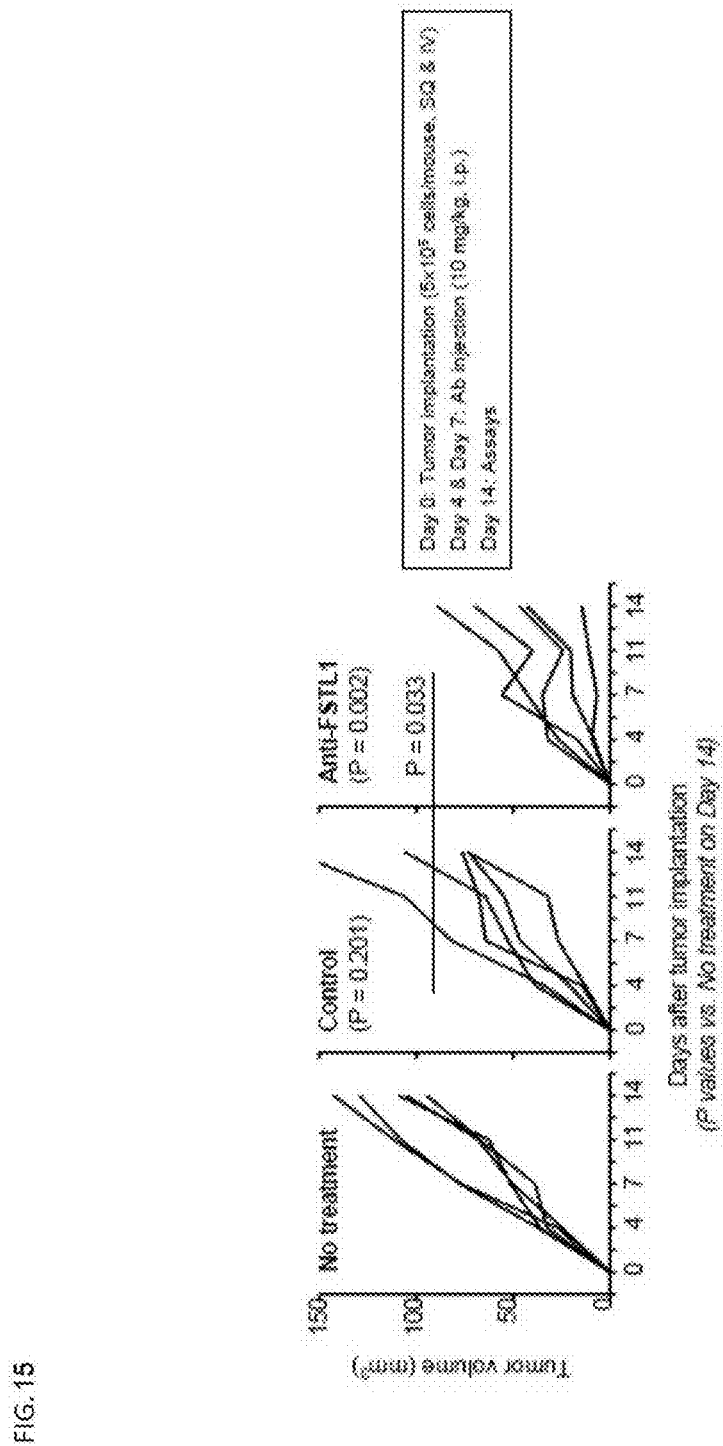
FIG. 15 also shows results of evaluating antibody activity in vivo (Example 21). This figure shows results of evaluating the drug efficacy of an anti-FSTL1 antibody using mouse breast cancer 4T1 cell-transplanted models. All of the 3 graphs show effects on tumor growth. This figure shows the tumor volume of each mouse individual (one line represents one mouse) measured 4, 7, 11, and 14 days after tumor implantation, and shows the effects of various antibodies on tumor growth. The left graph depicts no treatment, the middle graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm$^3$). On day 0, tumor cells were transplanted ($5\times10^5$ cells subcutaneously & $5\times10^5$ cells intravenously). On days 4 and 7, the antibody was intraperitoneally administered (10 mg/kg). On day 14, drug efficacy evaluation (subcutaneous tumor growth) was conducted. The drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The growth of 4T1 subcutaneous tumor was able to be significantly suppressed by the administration of the anti-FSTL1 antibody (#6-55).

The results are shown in FIG. 15. The growth of 4T1 subcutaneous tumor was able to be significantly suppressed by the administration of the anti-FSTL1 antibody (#6-55).

Example 22: In Vivo Antibody Activity Evaluation-Melanoma B16-10

In this Example, the drug efficacy of the anti-FSTL1 antibody was evaluated using mouse melanoma B16-F10.

The drug efficacy of the anti-FSTL1 antibody was evaluated according to Examples 17 to 20 using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests.
1. Experiment group (n=5)
1. Mouse melanoma B16-F10+control IgG (anti-DNP mAb)
2. Mouse melanoma B16-F10+anti-FSTL1 mAb (#6-55)
2. Experimental procedure
Day 0: transplantation of tumor cells ($1 \times 10^6$ cells subcutaneously & $1 \times 10^6$ cells intravenously)
Day 3: intraperitoneal administration of the antibody (first dose, corresponding to 200 µg/mouse=10 mg/kg)
Day 6: intraperitoneal administration of the antibody (second dose, corresponding to 200 µg/mouse=10 mg/kg) Day 15 various immunological assays
3. Index for drug efficacy evaluation
   Effects on the growth of subcutaneous tumor (calculation of tumor volume by tumor size measurement): measured 6, 10, and 14 days after tumor implantation (FIG. 16A)
   Effects on weight loss (FIG. 16B)
(Results)

Figure 16:
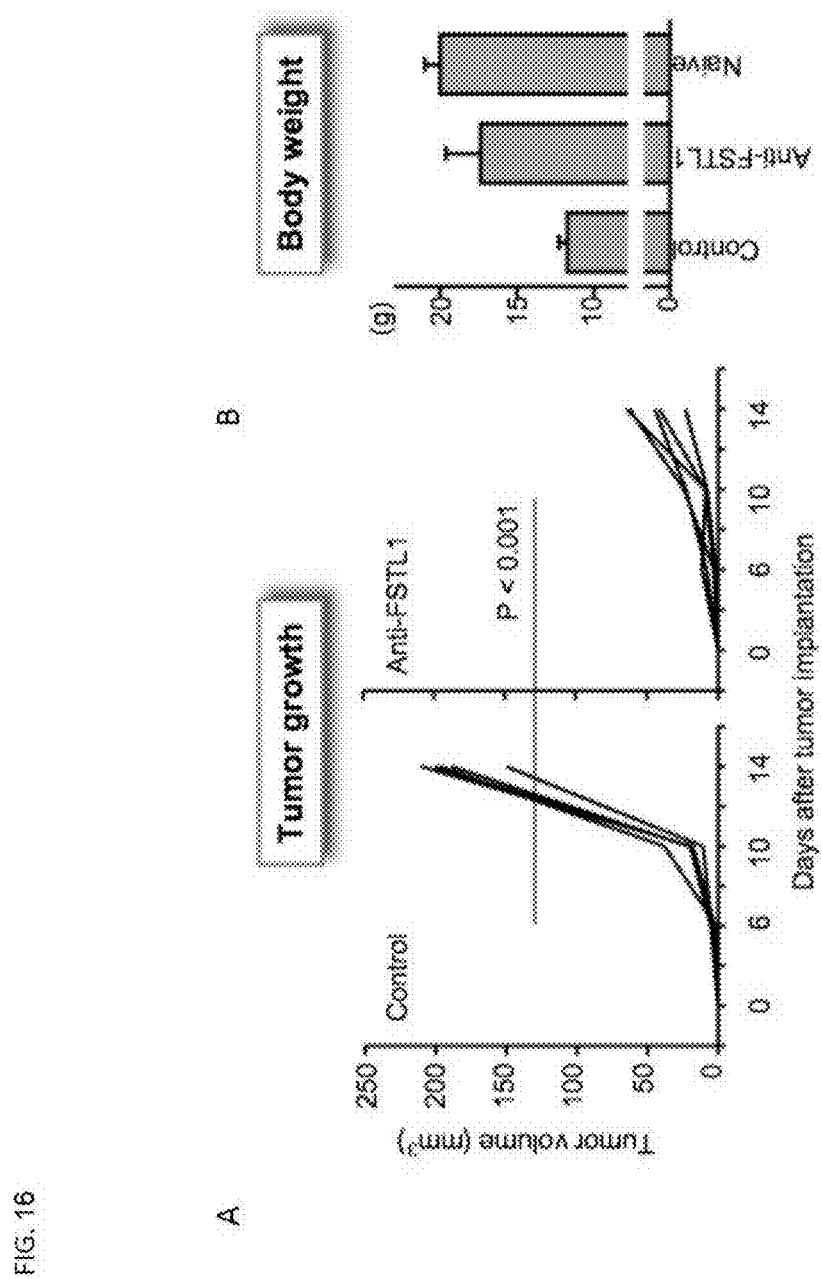
FIG. 16 Part A also shows results of evaluating antibody activity in vivo (Example 22). This figure shows results of evaluating the drug efficacy of an anti-FSTL1 antibody using mouse melanoma B16-F10. Both two graphs of the left panel show effects on tumor growth. This figure shows the tumor volume of each mouse individual (one line represents one mouse) measured 6, 10, and 14 days after tumor implantation, and shows the effects of various antibodies on tumor growth. The left graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume (mm$^3$). Part B shows effects on weight change. The left bar depicts a control antibody, the middle bar depicts the anti-FSTL1 antibody, and the right bar depicts an untreated individual that received no tumor cell. The ordinate shows tumor volume (g). The drug efficacy of the anti-FSTL1 antibody was evaluated using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests. Subcutaneous tumor growth was strongly suppressed by the administration of the anti-FSTL1 antibody (#6-55), as compared with the control antibody administration group. Also, suppressive activity against weight loss was also exhibited.

The results are shown in FIG. 16. Subcutaneous tumor growth was strongly suppressed by the administration of the anti-FSTL1 antibody (#6-55), as compared with the control antibody administration group. In the anti-FSTL1 antibody administration group, suppressive activity against weight loss was also exhibited (FIG. 16A), and neither remarkable emaciation nor fluffing, etc. was observed (FIG. 16B). Thus, all of the mice were fine. In this model, lung metastasis is usually observed 20 to 30 days after implantation. This evaluation was conducted approximately 2 weeks after implantation according to the timing in the preceding tests. Therefore, no metastatic nodule in the lung was macroscopically observed.

Example 23: In Vivo Antibody Activity Evaluation-Lymphoma

In this Example, the drug efficacy of the anti-FSTL1 antibody was evaluated using mouse lymphoma EL4.

The drug efficacy of the anti-FSTL1 antibody was evaluated according to Examples 17 to 20 using mouse lymphoma EL4, which is a cancer type having enhanced FSTL1 expression.
1. Experiment group (n=5)
1. Mouse lymphoma EL4+control IgG (anti-DNP mAb)
2. Mouse lymphoma EL4+anti-FSTL1 mAb (#6-55)
2. Experimental procedure
Day 0: transplantation of tumor cells ($1\times10^6$ cells subcutaneously & $1\times10^6$ cells intravenously)
Day 3: intraperitoneal administration of the antibody (first dose, corresponding to 200 μg/mouse=10 mg/kg)
Day 6: intraperitoneal administration of the antibody (second dose, corresponding to 200 μg/mouse=10 mg/kg)
Day 15: various immunological assays
3. Index for drug efficacy evaluation
   Effects on the growth of subcutaneous tumor (calculation of tumor volume by tumor size measurement): measured 3, 6, and 10 days after tumor implantation
(Results)

Figure 17:
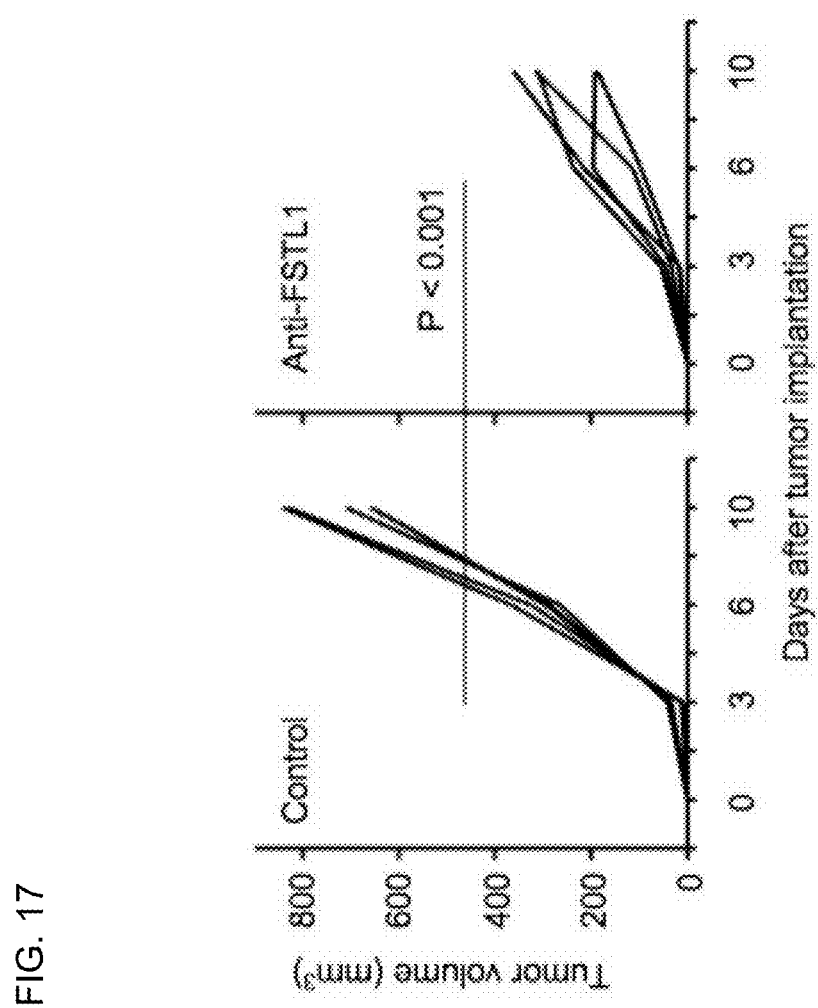
FIG. 17 also shows results of evaluating antibody activity in vivo (Example 23). This figure shows results of evaluating the drug efficacy of an anti-FSTL1 antibody using mouse lymphoma EL4. Both two graphs show effects on tumor growth. This figure shows the tumor volume of each mouse individual (one line represents one mouse) measured 3, 6, and 10 days after tumor implantation, and shows the effects of various antibodies on tumor growth. The left graph depicts a control antibody, and the right graph depicts the anti-FSTL1 antibody. The numerical values within the parentheses and the numerical values on the lines (indicated by P) represent p values regarding statistical significance (day 14). The abscissa shows the number of days. The ordinate shows tumor volume (mm3). The drug efficacy of the anti-FSTL1 antibody was evaluated using mouse lymphoma EL4, which is a cancer type having enhanced FSTL1 expression. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group.

The results are shown in FIG. 17. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group. It can be concluded that the proven effectiveness for lymphoma, one highly FSTL1-expressing cancer type comparable to breast cancer, is very useful data for developing clinical trials.

Example 24: In Vivo Antibody Activity Evaluation-Melanoma B16-10, Subcutaneous Transplantation In this Example, the drug efficacy of the anti-FSTL1 antibody was evaluated using mouse melanoma B16-F10.

The drug efficacy of the anti-FSTL1 antibody was evaluated in the same test system as in Example 22 according to Examples 17 to 20 except that only subcutaneous transplantation was performed here in order to more clearly evaluate reactivity.
1. Experiment group (n=5)
1. Control IgG (anti-DNP), 10 mg/kg
2. Anti-FSTL1 mAb (#6-55), 1 mg/kg
3. Anti-FSTL1 mAb (#6-55), 3 mg/kg
4. Anti-FSTL1 mAb (#6-55), 10 mg/kg
2. Experimental procedure
Day 0: subcutaneous transplantation of mouse melanoma B16-F10 cells ($1\times10^6$ cells)
Day 4: intraperitoneal administration of the antibody (first dose)
Day 8: intraperitoneal administration of the antibody (second dose)
Day 15: various immunological assays
3. Index for drug efficacy evaluation
   Effects on the growth of subcutaneous tumor (calculation of tumor volume by tumor size measurement): measured 6, 10, and 14 days after tumor implantation (Results)

Figure 18:
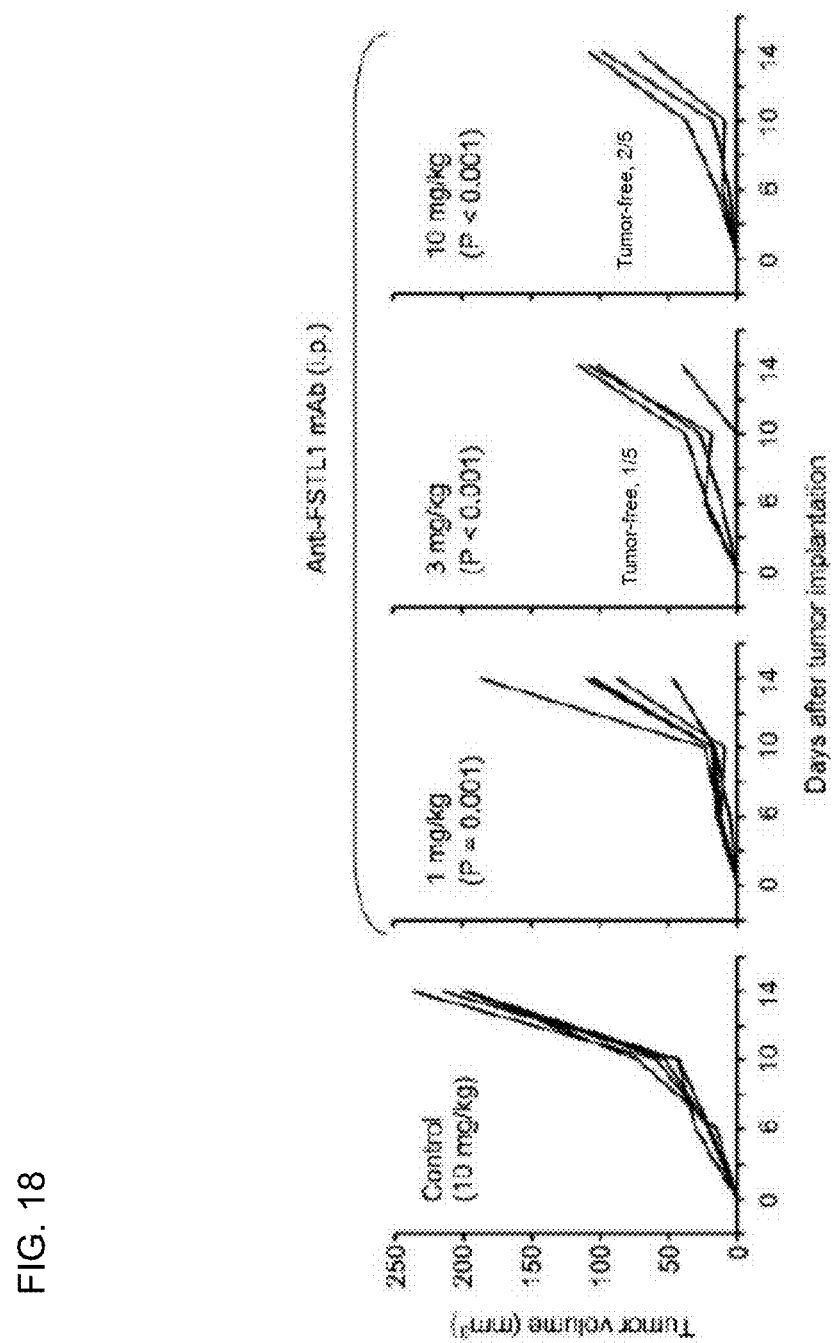
FIG. 18 also shows results of evaluating antibody activity in vivo (Example 24). This figure shows results of evaluating the drug efficacy of an anti-FSTL1 antibody using mouse melanoma B16-F10. All of the 4 graphs show effects on tumor growth. This figure shows the tumor volume of each mouse individual (one line represents one mouse) measured 6, 10, and 14 days after tumor implantation, and shows the effects of various antibodies on tumor growth. The leftmost graph depicts a control antibody, the second graph from the left depicts 1 mg/kg of the anti-FSTL1 antibody, the second graph from the right depicts 3 mg/kg of the anti-FSTL1 antibody, and the rightmost graph depicts 10 mg/kg of the anti-FSTL1 antibody. The numerical values within the parentheses and the numerical values on the lines (indicated by P) represent p values regarding statistical significance (day 14). The abscissa shows the number of days. The ordinate shows tumor volume (mm$^3$). The drug efficacy of the anti-FSTL1 antibody was evaluated in the same test system as in the experiment illustrated in FIG. 16 except that only subcutaneous transplantation was performed here in order to more clearly evaluate reactivity. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

The results are shown in FIG. 18. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Example 25: Treg Induction Inhibitory Activity of Anti-FSTL1 Antibody Using Human Peripheral Blood Cell In this Example, the Treg induction inhibitory activity of the anti-FSTL1 antibody was evaluated using human peripheral blood cells.

Human peripheral blood cells ($1\times10^6$ cells) were stimulated using FSTL1 (5 ng/ml), supplemented with the antibody (5 μg/mL), and cultured for 3 days. The percentage of a $Foxp3^+CTLA4^+$ cell fraction (Exp. 1) or a $CD4^+Foxp3^+CTLA4^+$ cell fraction (Exp. 2) in $CD4^+$ T cells was analyzed as Treg cells by flow cytometry. The flow cytometry conditions are as follows.

Blood was collected from a healthy person by the addition of a 1/10 amount of 4% sodium citrate, then layered on Ficoll (specific gravity: 1.090), and centrifuged (1500 rpm, 20 min, room temperature), and a cell fraction present in an intermediate layer was used as "PBMCs". The antibody (5 μg/mL) was added to a system in which these PBMCs ($1\times10^6$ cells) were cultured for 3 days under stimulation with FSTL1 (5 ng/ml) in a 24-well plate. PBMCs recovered from the culture system were incubated at 4° C. for 1 hour using an anti-CD4 antibody (BD Pharmingen/Becton, Dickinson and Company), an anti-CD25 antibody (BD Pharmingen/Becton, Dickinson and Company), and an anti-FoxP3 antibody (eBioscience). Then, the percentage of a Foxp3+CTLA4+ cell fraction (Exp. 1) or a CD4+ Foxp3+CTLA4+ cell fraction (Exp. 2) in CD4+ T cells contained therein was analyzed as Treg cells using a flow cytometer FACScan (Becton, Dickinson and Company).

Figure 19:
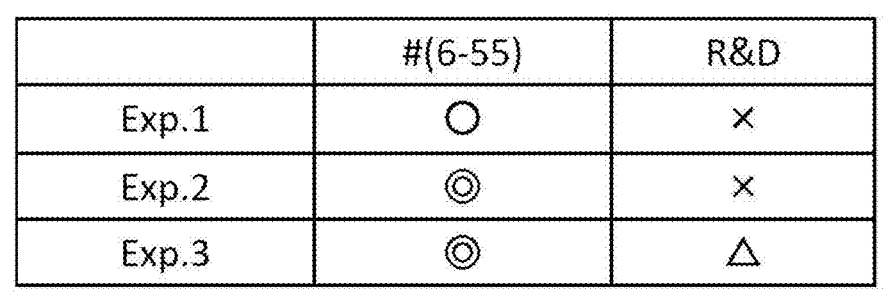

FIG. 19 summarizes these data and results in a table. The double circle, the circle, and the triangle depict statistical significance and represent 30% or more decrease, 10% to 30% decrease, and less than 10% decrease, respectively. The cross mark represents the absence of statistically significant difference. The results revealed that Tregs remarkably increase in number by stimulation with FSTL1, as with TGFb, etc., and this is significantly suppressed by the addition of antibody #6-55 of the present invention (the difference of Exp. 1 from Exp. 2 or 3 is based on difference in peripheral blood donor). On the other hand, a known antibody R&D antibody (R&D Systems, Inc., Cat. No. MAB1694, clone 229007) hardly exhibited inhibition. Here, the superiority of antibody #6-55 of the present invention was also confirmed again. These results indicated that antibody #6-55 of the present invention can remarkably inhibit Treg induction caused by FSTL1.

Example 26: Influence of Anti-FSTL1 Antibody on Proliferative Capacity and Invasive Capacity of Various Human Tumor Cells, Etc.

In this Example, the influence of the anti-FSTL1 antibody on the proliferative capacity and invasive capacity of various human tumor cells, the action of the anti-FSTL1 antibody under FSTL1 stimulation, and the action of the anti-FSTL1 antibody on cells forced to express Snail were examined.

Figure 20:
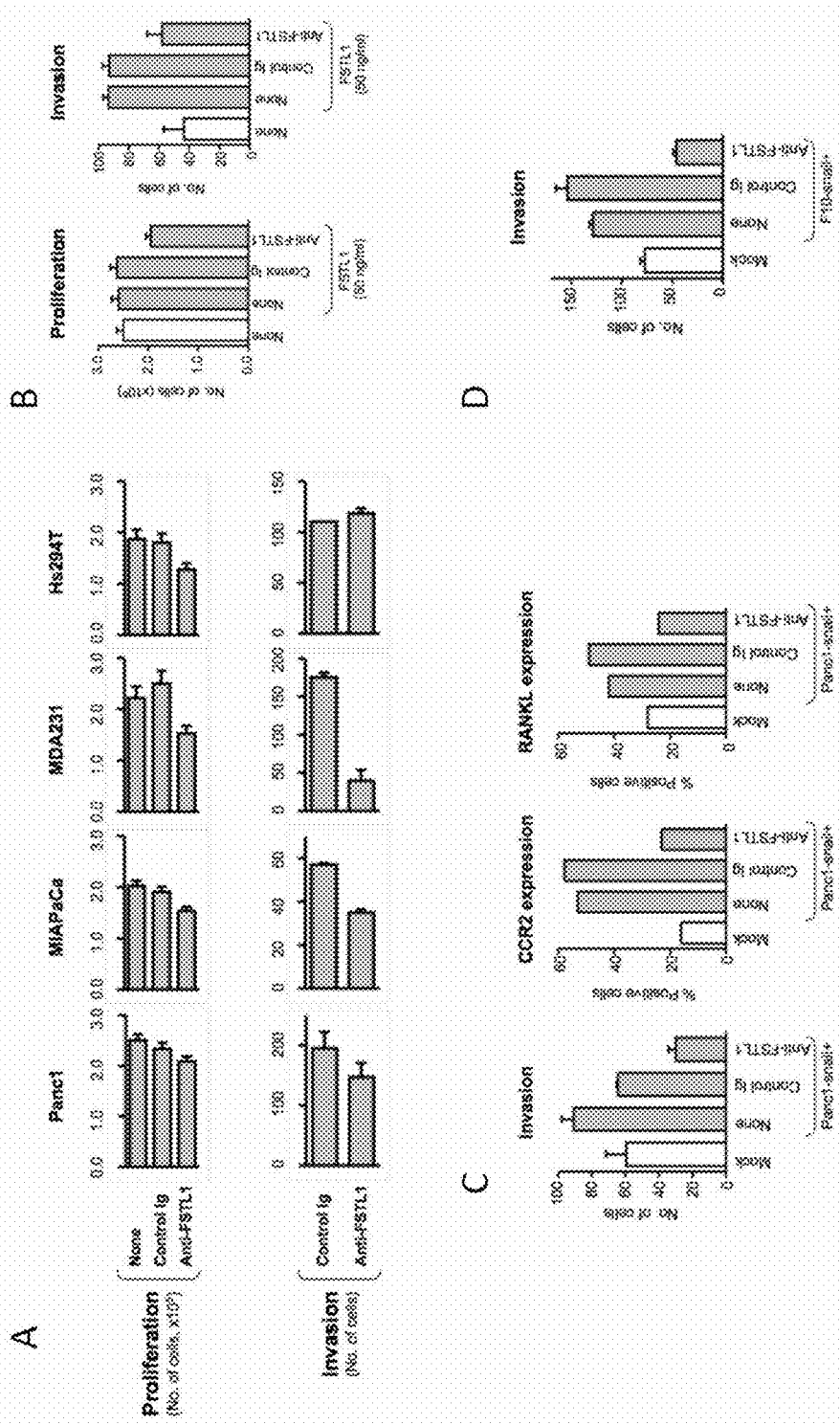
FIG. 20 shows results of examining various functions of an anti-FSTL1 antibody. Panel A shows the influence of the anti-FSTL1 antibody on the proliferative capacity and invasive capacity of various human tumor cells. The upper graphs of panel A show the results about proliferation, and the lower graphs show the results about invasion. Pancl, MIAPaCa, MDA231, and Hs294 are depicted from the left to the right. The upper graphs show the number of cells ($\times 10^3$) after culture for 3 days. The lower graphs show the number of tumor cells treated with the antibody for 3 days. In each of the upper graphs, none, control IgG, and the anti-FSTL1 antibody are depicted from the upper to lower bars. In each of the lower graphs, the upper bar depicts control IgG, and the lower bar depicts the anti-FSTL1 antibody. These results demonstrated that Snail+ tumor cells have very high metastatic properties. Panel B shows the action of the anti-FSTL1 antibody under FSTL1 stimulation. The left graph shows proliferative capacity, and the right graph shows invasive capacity. In both graphs, the left bar depicts none, and the second to fourth bars from the left depict none, mouse IgG, and the anti-FSTL1 antibody (#6-55) in order in the presence of FSTL1 (50 ng/ml). Panels C and D show the action of the anti-FSTL1 antibody on cells forced to express Snail. Panel C shows the results about Matrigel invasion, CCR2 expression, and RANKL expression from the left to the right. In all of the graphs, the left bar depicts Panel cells of a parent line that were not forced to express Snail (Mock), and the second bar from the left to the rightmost bar depict none, mouse IgG, and the anti-FSTL1 antibody (#6-55) in order in the presence of the anti-FSTL1 antibody (50 ng/ml). Panel D shows results obtained in Snail transfectants of mouse melanoma B16t-F10. In the graph, the left bar depicts a false antibody (Mock), and the second bar from the left to the rightmost bar depict none, mouse IgG, and the anti-FSTL1 antibody (#6-55) in order in the presence of FSTL1 (50 ng/ml).

Specifically, the influence of the anti-FSTL1 antibody on proliferative capacity and invasive capacity was studied using various human tumor cells, regardless of the presence or absence of the expression of Snail or FSTL1. Specifically, the anti-FSTL1 antibody (#6-55, 5 µg/ml) or a control antibody (aHema: mouse chimeric anti-hemagglutinin antibody, 5 µg/ml) was added to systems in which a pancreatic cancer cell line Pancl (ATCC # CRL-1469), Pancl-snail+ which is a Pancl cell line forced to express Snail, a pancreatic cancer cell line MIAPaCa (ATCC # CRL-1420), a bone metastatic breast cancer cell line MDA231 (ATCC # HTB-26), and a melanoma cell line Hs294T (ATCC # HTB-140) were each cultured at $1 \times 10^5$ cells. After culture for 3 days, the number of cells per culture system was counted to evaluate the proliferative capacity of the cells. The cells ($5 \times 10^4$ cells) after the counting were further inoculated to Matrigel-coated transwell chamber (Corning Inc. #354480) and cultured for 4 hours. Then, the membranes were removed, and stained and fixed with Crystal Violet fixative. Then, the number of cells that permeated the membranes was counted under a microscope to evaluate the invasive capacity of the cells. As a result, both proliferative capacity and invasive capacity were strongly suppressed, particularly, in a highly metastatic tumor cell line highly expressing Snail. This indicated that the anti-FSTL1 antibody acts particularly on tumor cells highly expressing FSTL1 and having EMT (FIG. 20A).

(Action of Anti-FSTL1 Antibody Under FSTL1 Stimulation)

Next, in order to examine how surrounding tumor cells were changed in a cancer microenvironment by receiving FSTL1 produced by Snail/FSTL1-expressing cells, and how the anti-FSTL1 antibody acts thereon, a human pancreatic cancer cell line Pancl confirmed to express Snail or FSTL1 only slightly was stimulated with FSTL1 for 3 days. The anti-FSTL1 antibody (#6-55, 5 µg/ml) or a control antibody (aHema, 5 µg/ml) was added to this culture system, and subsequent change in cell function was analyzed in the same way as in the preceding paragraph. As a result, as previously reported in the paper (Cancer Res; 73 (20); 6185-93, 2013), FSTL1 had little influence or contribution on or to tumor growth, whereas the cell growth was reduced by the addition of the anti-FSTL1 antibody together with FSTL1. The paper also reports that FSTL1 enhances invasive capacity. It was revealed that the action thereof is canceled (FIG. 20B).

(Action of Anti-FSTL1 Antibody on Cell Forced to Express Snail)

Cell invasion was evaluated in the presence of the anti-FSTL1 antibody (#6-55, 5 µg/ml) or a control antibody (aHema, 5 µg/ml) in a chamber using Pancl-snail+, a cell line forced to express Snail, instead of the FSTL1-stimulated tumor cells of the preceding paragraph. The results are very similar to the results of the preceding paragraph, and suppressive activity was able to be confirmed in 6-55 (FIG. 20C)).

In this Example, Pancl-snail+ cells were cultured for 3 days in the presence of the added antibody. Then, the expression of CCR2 and RANKL among molecules known as bone metastasis markers was analyzed by flow cytometry. As a result, both CCR2 and RANKL were strongly suppressed by the anti-FSTL1 antibody. The anti-FSTL1 antibody presumably has inhibitory activity against cell invasion (FIG. 20D).

Example 27: MSC Induction Inhibition Test Using Mouse Bone Marrow Cell

In this Example, the inhibitory activity of the anti-FSTL1 antibody was confirmed in an experimental system of mesenchymal stem cell induction while a FSTL1 inhibitory effect on MSC expansion induced not only by FSTL1 but by Snail+ tumor cells was also evaluated. For specific operation, each antibody (10 µg/mL) was added to systems in which C57/BL/6 mouse-derived bone marrow cells were stimulated with FSTL1 (20 ng/mL) or a culture supernatant of tumor cells. After culture for 8 days under stimulation, cell fraction CD45(−) cells (MSCs) containing MSCs at a high rate and CD45(−)CD146(+)ALCAM(+) cells (sMSCs) increasing in number in association with cancer metastasis were analyzed by flow cytometry in the same way as in Example 14, and the number of cells per culture system was counted. In this Example, mouse immunoglobulin manufactured by BioLegend, Inc. (#401408, Cone MG1-45) was used as a control antibody.

Figure 21:
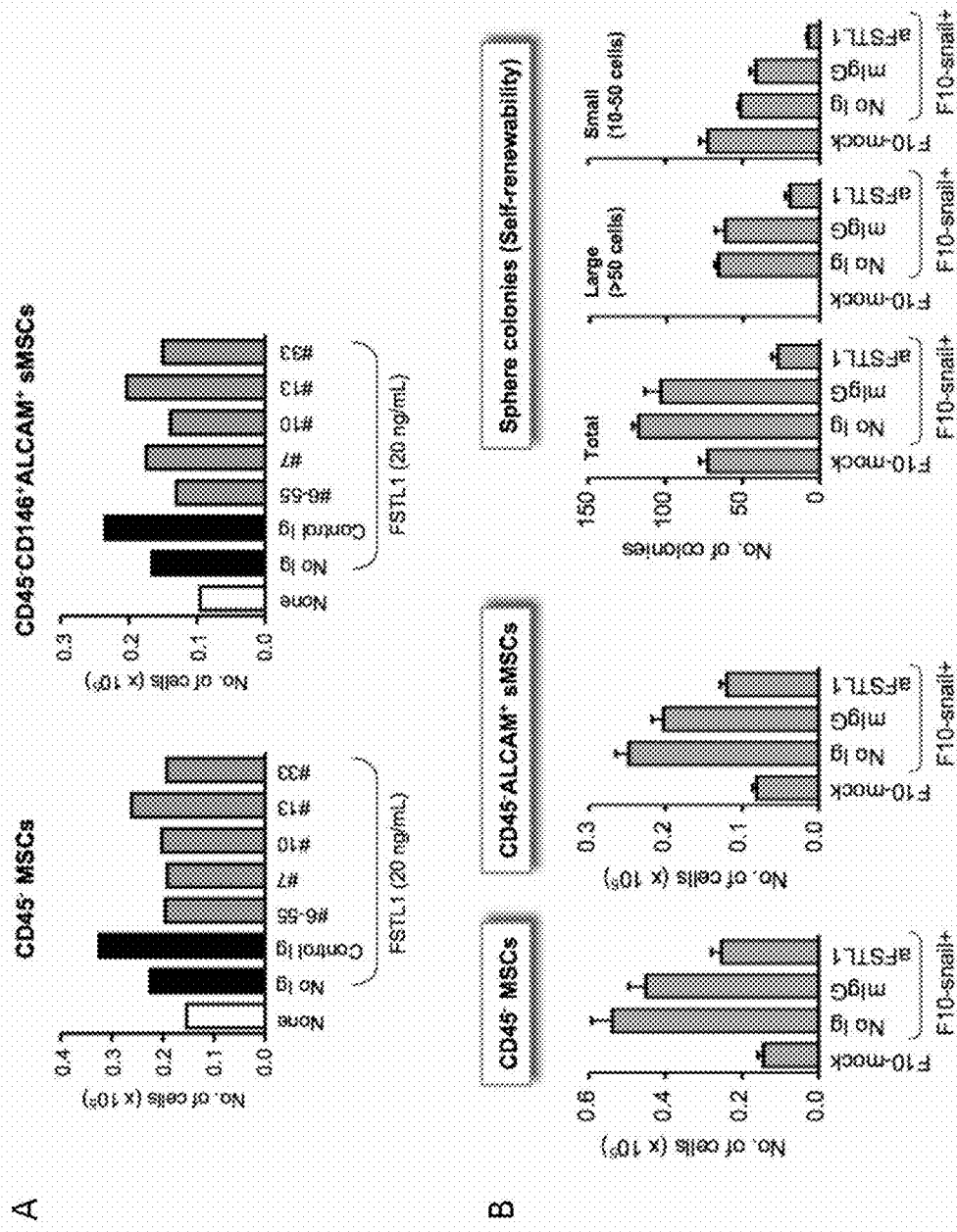
FIG. 21 shows results of a MSC induction inhibition test using mouse bone marrow cells. In panel A, the left graph depicts CD45+ MSC cells, and the right panel depicts CD45$^+$CD146$^+$ALCAM$^+$ sMSCs. The left bar depicts none, and the second bar from the left to the rightmost bar show results obtained in FSTL1 (20 ng/ml) and depict no immunoglobulin, mouse immunoglobulin, and the antibody #6-55, #7, #10, #13, and #33 of the present invention in order. Panel B depicts CD45$^-$ MSC cells, CD45$^-$ALCAM$^+$ sMSC cells, and sphere colonies (self-renewability). The leftmost bar depicts F10-mock, and the second bar from the left to the rightmost bar depict F10-snail+. Results about no immunoglobulin, mouse immunoglobulin, and the anti-FSTL1 antibody are shown in order from the second bar from the left. The results are indicated by the number of cells in the left and middle graphs. The sphere colonies represent the number of colonies. Among the 3 graphs of the sphere colonies, the left graph shows the total number, the middle graph shows large colonies (>50 cells), and the right graph shows small colonies (10 to 50 cells).

The results are shown in FIG. 21. As shown in FIG. 21A, in the MSC induction inhibition test of this Example, #7, #10, #13, and #33 exhibited a strong inhibitory effect equivalent to or higher than that of #6-55 in flow cytometry analysis. As a result, #7, #10, and #33 exhibited high MSC induction inhibitory activity equivalent to or higher than that of #6-55, and reproducibility was able to be confirmed in these 3 clones.

(Influence on MSC Expansion Induced by Tumor Cell)

In this Example, whether or not the anti-FSTL1 antibody could inhibit MSC expansion induced by a culture supernatant of Snail+ tumor cells was evaluated in a MSC induction system using bone marrow cells. C57/BL/6 mouse-derived bone marrow cells were supplemented with the culture supernatant of Snail+ tumor cells and each antibody (10 µg/mL) and cultured for 8 days under stimulation. Then, the following 2 cell groups were analyzed by flow cytometry.

1) General cell fraction "CD45(−) cells" containing MSCs at a high rate
2) "CD45(−)ALCAM(+)CD271(+) cells (=sMSCs)" increasing in number in association with cancer metastasis Formed sphere colonies were classified into large colonies each formed by 50 or more cells and small colonies each formed by 50 or less cells, and observed under a microscope on culture day 8. As a result, as shown in FIGS. 21B to 21D, the induction of MSCs and sMSCs was remarkably inhibited, and the formation of sphere colonies exhibiting the ability to self-renew, which typifies the nature of stem cells, was also strongly suppressed. This suggested the possibility that the FSTL1 antibody exerts an antitumor effect in vivo by inhibiting the induction of MSCs amplified by cancer metastasis.

Example 28: Treg Induction Inhibition Test Using Mouse Spleen Cell

In this Example, newly prepared 3 anti-FSTL1 antibodies differing in epitope were evaluated for their inhibitory activity against Treg induction in a mouse system.

(Material and Method)

In this Example, the experiment was conducted according to Example 17. Specifically, 5 µg/mL of each antibody was added to a system in which C57/BL/6 mouse-derived spleen cells ($2 \times 10^6$ cells) were stimulated with 5 ng/ml of FSTL1. After culture for 3 days, the percentage (%) of a Foxp3+ CTLA4+ cell fraction in CD4+ T cells was analyzed as Treg cells by flow cytometry. Activity was compared with #6-55 used in the preceding studies.

(Results)

Figure 22:
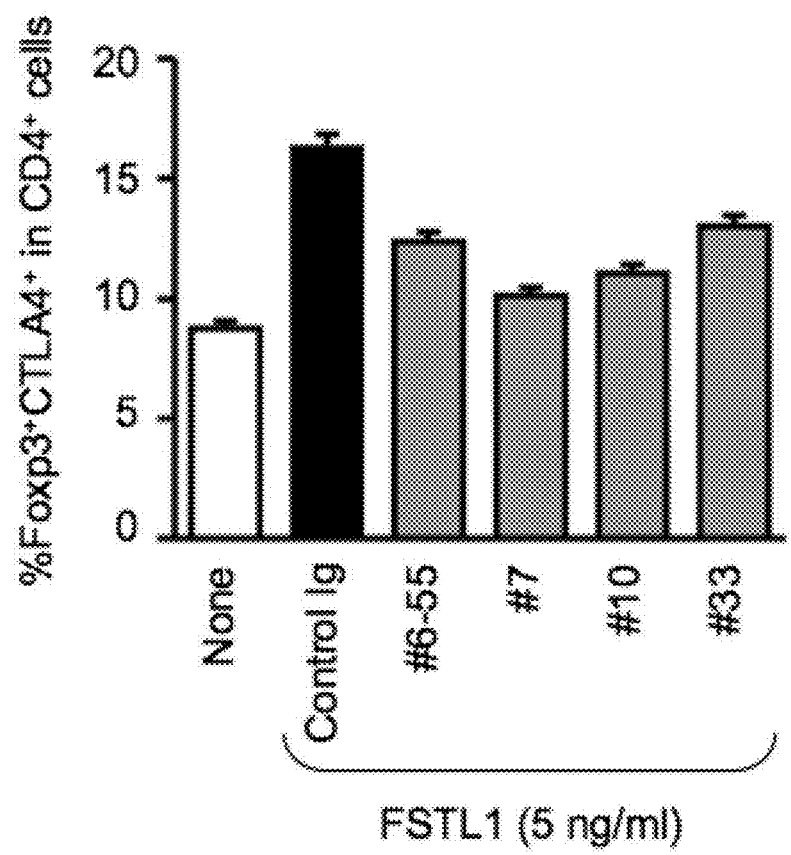
FIG. 22 shows results of a Treg induction inhibition test using mouse spleen cells. The graph shows the percentage of Foxp3$^+$CTLA4$^+$ cells in CD4$^+$ cells. The leftmost bar depicts none, and the second bar from the left to the rightmost bar show results of the experiment in the presence of FSTL (5 ng/ml). Mouse immunoglobulin, and the antibody #6-55, #7, #10, and #13 of the present invention are depicted in order from the second bar from the left.

As a result, as shown in FIG. 22, all of the new 3 clones suppressed Treg induction, as compared with the control antibody. Particularly, #7 and #10 exhibited strong suppressive activity equal to or higher than that of #6-55. The Treg induction inhibitory activity of the anti-FSTL1 antibody was also able to be properly confirmed in a human evaluation system using human peripheral blood cells in other Examples. High-impact inhibitory activity was more clearly observed in this mouse evaluation system in this Example. Both #7 and #10 are clones recognizing 205-228 a.a. of FSTL1, indicating that in addition to 148-162 a.a. recognized by #6-55, 205-228 a.a. is also a region important for the activity of FSTL1.

Example 29: Inhibitory Activity of Newly Prepared 3 Anti-FSTL1 Antibodies Differing in Epitope Against Mouse Tumor Activation In this Example, newly prepared 3 anti-FSTL1 antibodies differing in epitope were evaluated for their inhibitory activity against mouse tumor activation.

(Material and Method)

A melanoma cell line F10-snail+ forced to express mouse Snail was supplemented with 5 µg/ml of the anti-FSTL1 antibody or a control antibody (anti-DNP antibody) and cultured for 3 days, and change in the properties of tumor cells was analyzed by various assays. Cell adhesion ability was evaluated by culturing the cells for 2 hours using a fibronectin-coated plate, and then counting the number of cells that adhered to the plate. The invasive capacity of the cells was evaluated by culturing the cells for 4 hours using Matrigel-coated transwell chamber, and then counting the number of cells that permeated the membrane. As for bone metastasis-associated molecule expression, the expression of typical molecular markers CCR2 and RANKL was analyzed by flow cytometry.

(Results)

Figure 23:
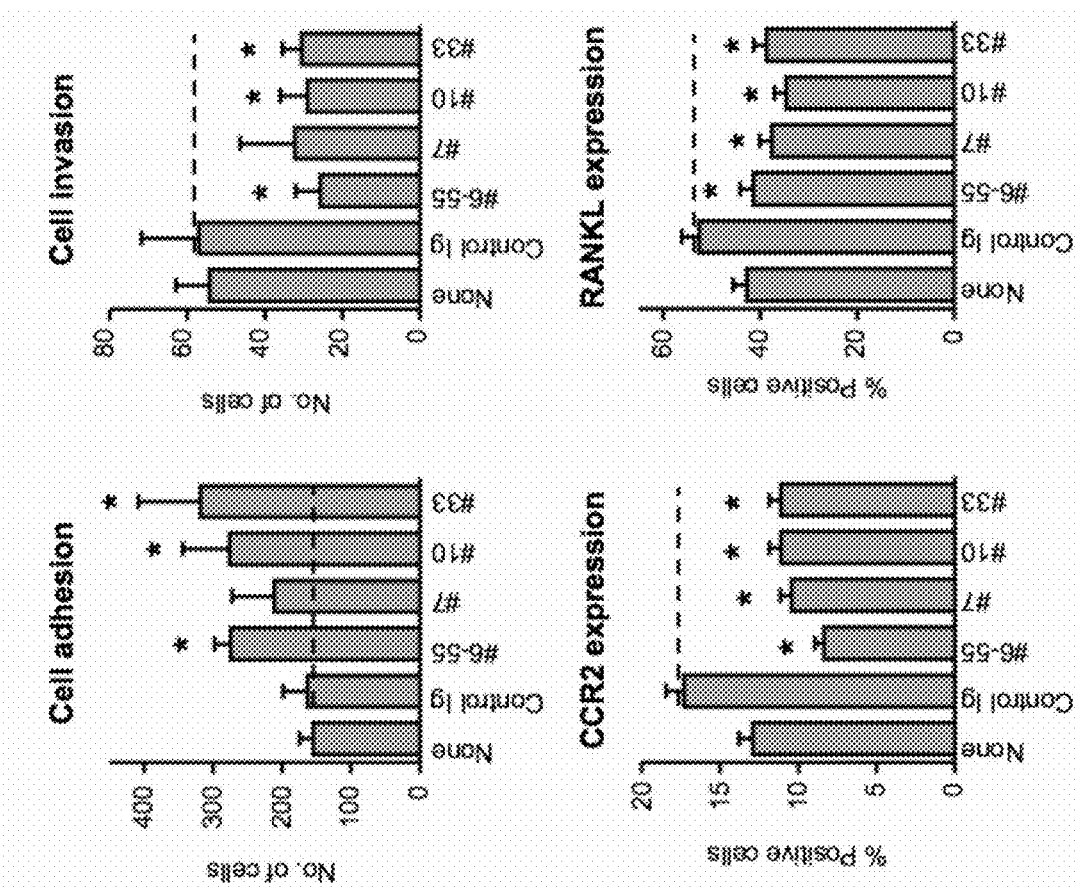
FIG. 23 shows results of evaluating newly prepared 3 anti-FSTL1 antibodies (#7, #10, and #33) differing in epitope for their inhibitory activity against mouse tumor activation. The upper left graph shows cell adhesion, the upper right graph shows cell invasion, the lower left graph shows CCR2 expression, and the lower right graph shows RANKL expression. In each graph, none, control immunoglobulin, and the antibody #6-55, #7, #10, and #33 of the present invention are depicted from the left to the right. * represents statistical significance (p<0.05).
Figure 24A:
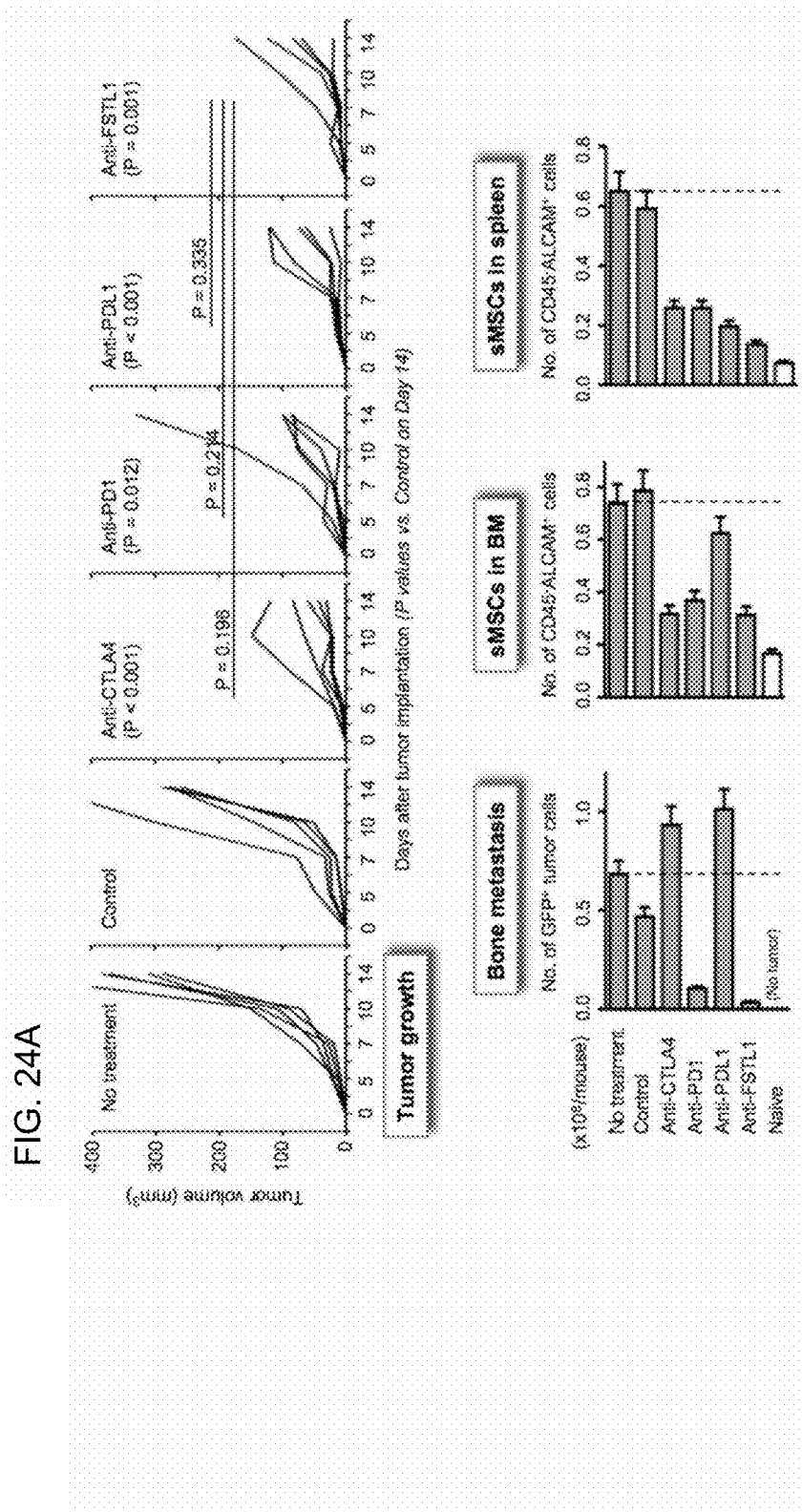
[FIG. 24A]
Figure 24B:
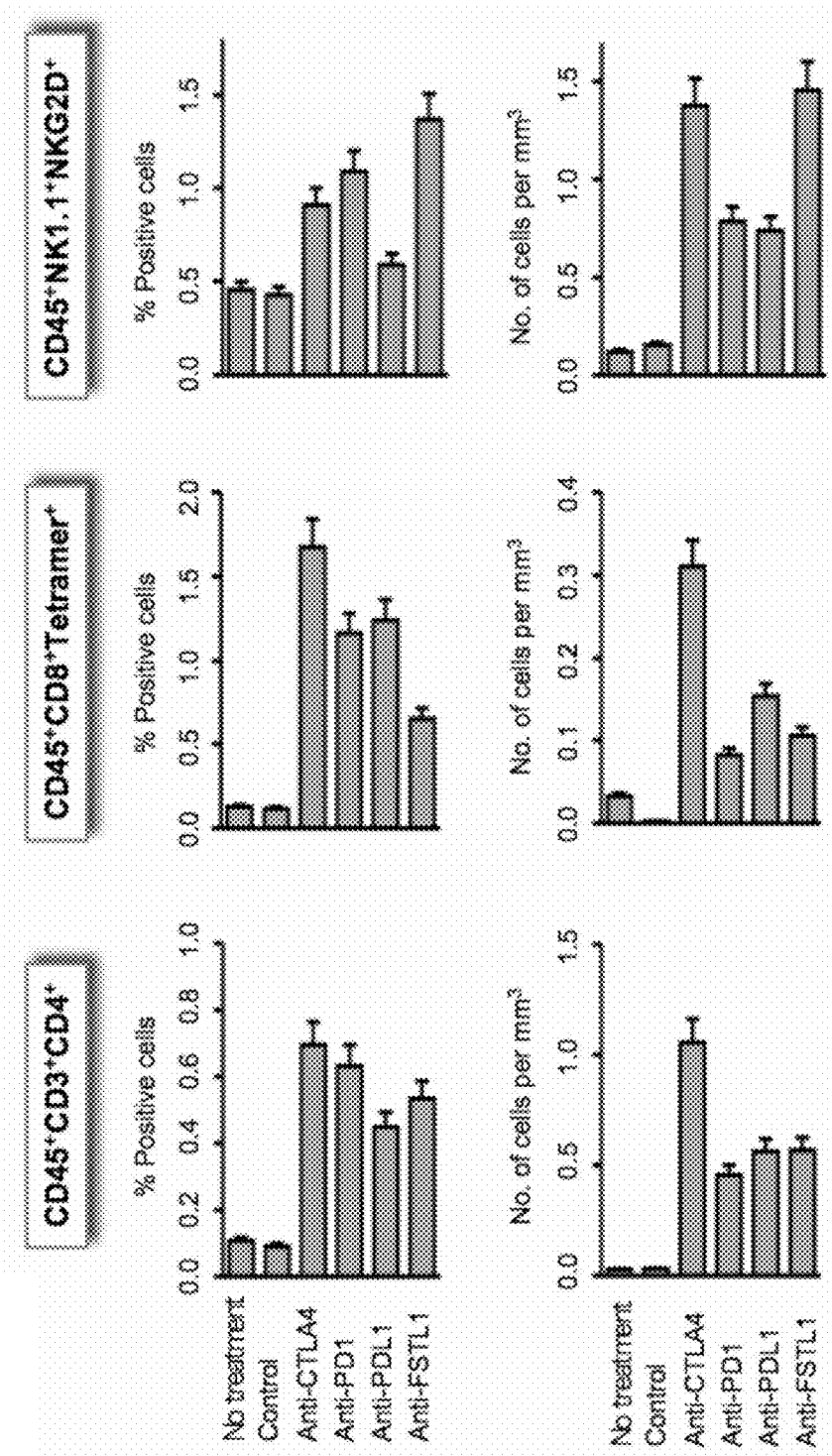
Figure 24C:
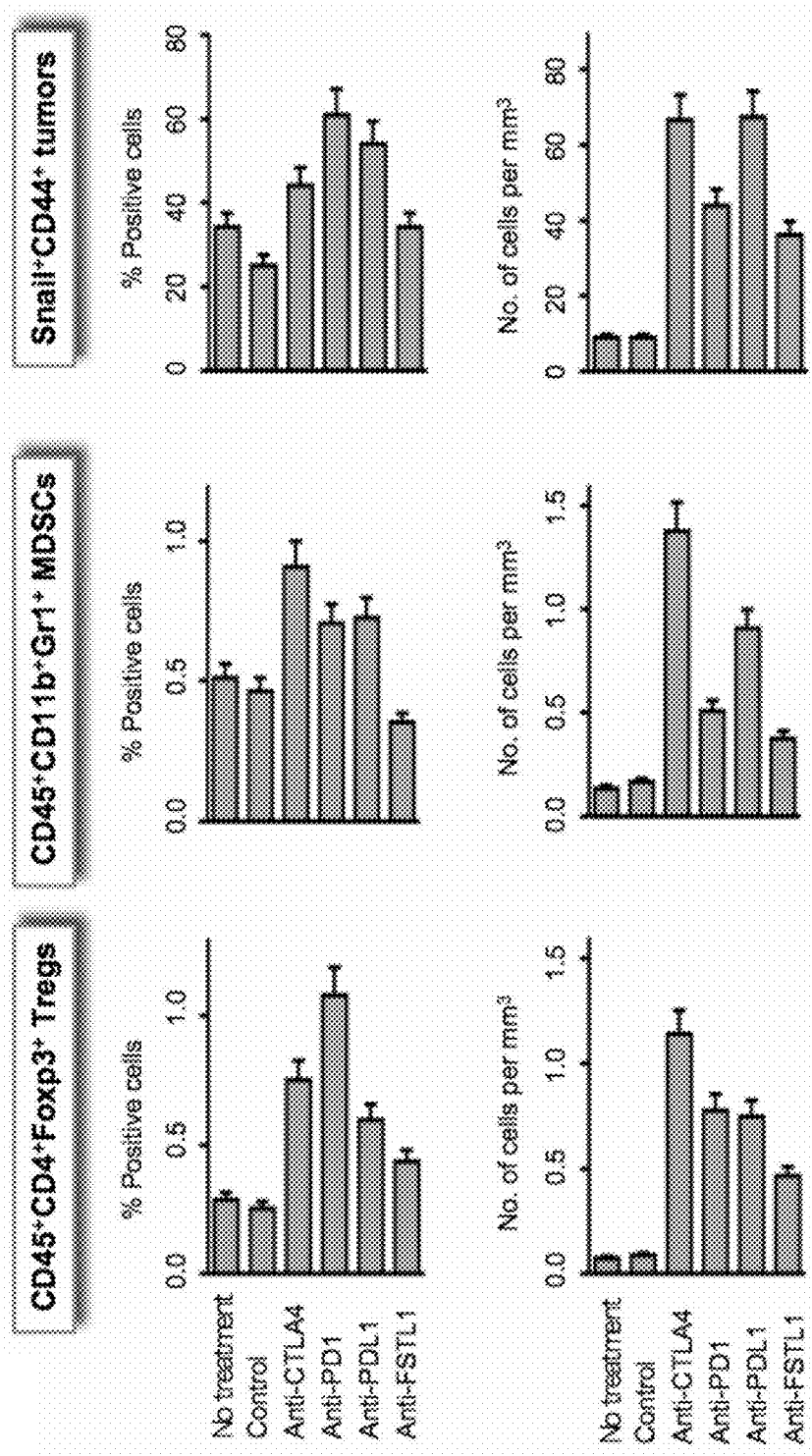
Figure 24D:
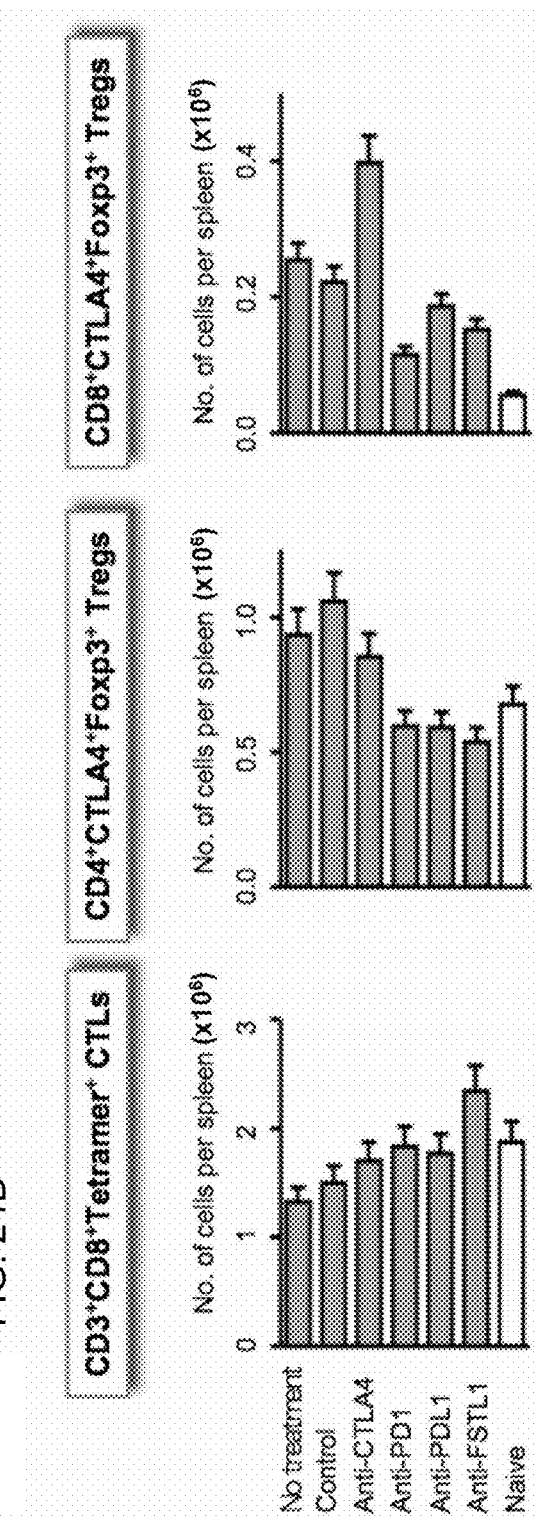

As shown in FIG. 23, all of the new clone antibodies significantly reduced the expression of CCR2 and RANKL and the invasive capacity of the cells and enhanced cell adhesion, as compared with the control antibody. This means that the cells were converted to epithelial cells. Both activities were substantially equivalent to those of #6-55, and no large difference was seen.

Example 30: In Vivo Drug Efficacy Comparison Between Antibody Drug for Immune Mitigation Already Used Clinically and Anti-FSTL1 Antibody Using Snail+ Tumor Bone Metastasis Model Drugs for immune mitigation such as anti-CTLA4 antibodies have received attention because their administration into tumor can directly ameliorate an immunosuppressed environment in the tumor acting advantageously to cancer cells, and can effectively enhance antitumor immunity (Clin Cancer Res 20: 1747, 2014). Thus, in vivo drug efficacy was compared between antibody drugs for immune mitigation already used clinically and the anti-FSTL1 antibody using Snail+ tumor bone metastasis models.

(Material and Method)

1. Experimental protocol
1-1. Experiment group (n=5)
1. No treatment (0.9% NaCl as a sham)
2. Control mouse IgG (mouse chimeric anti-hemagglutinin antibody, also referred to as aHema)
3. Anti-CTLA4 mAb (Clone 9H10, BioLegend)
4. Anti-PD1 mAb (Clone 9F.1A12, BioLegend)
5. Anti-PDL1 mAb (Clone 10F.9G2, BioLegend)
6. Anti-FSTL1 mAb (#6-55)
7. Naive (no tumors, no treatment)
1-2. Experimental procedure
Day 0: transplantation of GFP+ Snail+B16-F10 tumor cells ($3 \times 10^5$ cells subcutaneously & $2 \times 10^4$ cells intravenously)
Day 5: intratumoral administration of the antibody (corresponding to 200 µg/mouse=10 mg/kg)
Day 14: various assays
1-3. Index for drug efficacy evaluation The following was used as an index for drug efficacy evaluation.

Effects on the growth of subcutaneous tumor (calculation of tumor volume by tumor size measurement)
Effects on bone metastasis (amount of GFP+ tumor cells in bone marrow)
Effects on sMSC expansion in bone marrow or the spleen
Influence on the immune system (Procedure)

The tumor volumes of the mice were measured 5, 7, 10, and 14 days after tumor implantation. Methods for evaluating effects on subcutaneous tumor growth, bone metastasis, and sMSC expansion in bone marrow and the spleen were performed in the same way as in Example 17. In order to evaluate influence on the immune system, the contents and numbers of CD4+ T cells (CD45+CD3+CD4+; FITC-labeled anti-CD3 antibody, PE-labeled anti-CD4 antibody, and Cy5-labeled anti-CD45 antibody, all from Becton, Dickinson and Company), tumor-specific CD8+ T cells (CD45+CD8+ tetramer+; FITC-labeled anti-CD8 antibody manufactured by Becton, Dickinson and Company, PE-labeled tetramer manufactured by Medical & Biological Laboratories Co., Ltd. (MBL), and Cy5-labeled anti-CD45 antibody), activated NK cells (CD45+NK1.1+NKG2D+; FITC-labeled anti-NK1.1 antibody, PE-labeled anti-NKG2D antibody, and Cy5-labeled anti-CD45 antibody, all from Becton, Dickinson and Company), immunosuppressive T cells (CD45+ CD4+ FOXP3+ Tregs; FITC-labeled anti-Foxp3 antibody manufactured by eBiosciences, PE-labeled anti-CD4 antibody, and Cy5-labeled anti-CD45 antibody), and MDSCs (CD45+CD11b+Gr1+ MDSCs; FITC-labeled anti-CD11b antibody, PE-labeled anti-Gr1 antibody, and Cy5-labeled anti-CD45 antibody, all from Becton, Dickinson and Company), which were cell groups in charge of antitumor immunity that invaded tumor, were analyzed by flow cytometry. Also, the content and number of highly metastatic tumor cells (Snail+CD44+ tumors; PE-labeled anti-Snail antibody manufactured by eBiosciences and Cy5-labeled anti-CD44 antibody manufactured by Becton, Dickinson and Company) in subcutaneous tumor was analyzed by flow cytometry.

(Results)

The growth of subcutaneous tumor was significantly suppressed in all of the treatment groups compared with the control antibody administration group, and no significant difference was confirmed among the treatment groups (FIG. 24-1). However, bone metastasis and MSC induction in bone marrow and the spleen were significantly suppressed by the FSTL1 antibody, whereas the CTLA4 antibody and the PDL1 antibody rather enhanced bone metastasis, and the PDL1 antibody did not inhibit MSC induction in bone marrow (FIG. 24-1). As a result of culturing bone marrow cells, the properties of tumor cells present therein differ between both groups. A large number of sphere colonies were formed in the CTLA4 antibody administration group, whereas strong adhesive properties were exhibited in the PDL1 antibody administration group.

On the other hand, as a result of analyzing immunocyte groups (TILs) that received the antibody and invaded subcutaneous tumor, a large number of CD4+ T cells, tumor-specific CD8+ T cells, and activated NK cells invaded tumor in all of the treatment groups (FIG. 24-2). Particularly, these antitumor effector cell groups were found to exceedingly remarkably increase in number by the intratumoral administration of the CTLA4 antibody. Interestingly, a larger number of activated NK cells, which have neither received attention nor been analyzed so far, than the number of tumor-specific CD8+ T cells invaded tumor in the FSTL1 antibody group, as with this CTLA4 antibody group (FIG. 24-2). NK cells are major effector cells of the natural immune system, as with MSC, and have also been reported as cells most susceptible to a suppressive effect by MSCs. Thus, the number or functions of NK cells were presumably improved or enhanced drastically because MSCs drastically decreased in number by the administration of the FSTL1 antibody.

As mentioned above, the antitumor effector cell groups increased in number in all of the treatment groups. Referring to the immunosuppressive cell groups, Tregs or MDSCs rather increased in number in the tumor of the existing antibody drug administration groups. Particularly, the MDSC expansion was markedly seen in the CTLA4 antibody administration group and the PDL1 antibody administration group (FIG. 24-3). Also, the CTLA4 antibody was unable to suppress Treg expansion in the spleen, and CD8+ Tregs increased in number (FIG. 24-4). This may be a rebounding effect after a lapse of days after administration, or a feedback phenomenon in which other immunosuppressive cell groups attempted to compensate for a part where CD4+ Tregs decreased in number. In an intratumoral environment, it is possible that tumor cells are stimulated by, for example, cytokines released by immunocytes that have invaded the environment, to induce EMT, etc. Therefore, change in tumor cells was also confirmed. First, the expression of main EMT marker Snail/CD44 was analyzed. As a result, the original tumor cells used in transplantation were Snail+CD44+, whereas a subpopulation fraction with the enhanced expression intensity of these markers was seen in tumor cells separated from subcutaneous tumor, demonstrating that EMT was rather promoted by treatment (FIG. 24-3). This de novo EMT was particularly markedly seen in the CTLA4 antibody administration group and the PDL1 antibody administration group in which MDSCs increased in number and bone metastasis was also aggravated. As seen from these results, the CTLA4 antibody and the PDL1 antibody were certainly able to recruit antitumor immunity-enhancing members into tumor to suppress tumor growth, but were unable to suppress the expansion of immunosuppressive cell groups, de novo EMT in tumor cells, etc. Therefore, systemic antitumor immunity was not ameliorated. As a result, presumably, bone metastasis was unable to be sufficiently inhibited. On the other hand, no major weak point was seen in data on the PD1 antibody. Particularly, the volume of bone metastasis or the amount of sMSCs is probably attributed to the very drastically decreased number of bone marrow cells. In other words, when the bone marrow cells of the PD1 antibody administration group were cultured, a large number of tumor cells formed colonies, as with the CTLA4 antibody administration group. In actuality, bone metastasis was probably rather aggravated, and tumor cells presumably accumulated in large amounts or grew excessively in a bone environment so that the growth of bone marrow cells was suppressed to drastically decrease the number of cells. The CTLA4 antibody was found to effectively recruit antitumor effector cells into tumor in this intratumoral administration compared with systemic administration. On the other hand, the FSTL1 antibody has a high effect of suppressing inferior parts, but does not have a much high effect of recruiting antitumor effector cells.

Example 31: Mouse Lung Cancer Model

Figure 25:
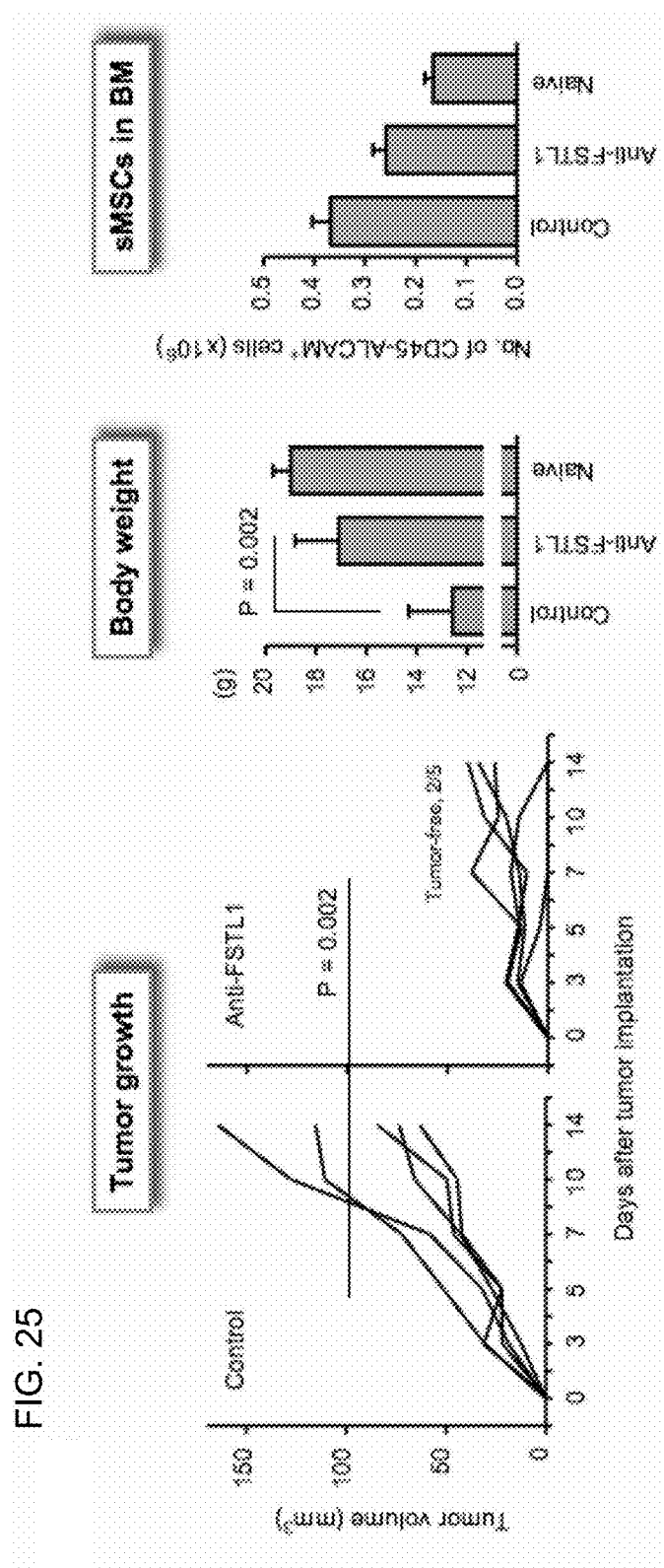
FIG. 25 shows results of evaluating drug efficacy (tumor growth, body weight, and the number of sMSCs in bone marrow) using mouse lung cancer models. For the tumor growth, statistical significance is indicated by p value. A control is depicted on the left, and an anti-FSTL1 antibody is depicted on the right. The abscissa shows the number of days after tumor implantation. The ordinate shows tumor volume (mm³). The middle graph shows animal body weight. A control, an antibody FSTL1 antibody, and naive are depicted from the left to the right. The body weight is indicated by g. The right graph shows sMSCs in bone marrow. A control, an anti-FSTL1 antibody, and naive are depicted from the left to the right. The number of CD45⁻ ALCAM⁺ cells (×10⁶) is shown.

In this Example, drug efficacy was evaluated using mouse lung cancer models in anticipation of the development of the anti-FSTL1 antibody as a therapeutic drug for lung cancer.
(Material and Method)
Experimental Protocol
Experiment Group (n=5)
1. Isotyoe mouse IgG (aHema)
2. Anti-FSTL1 mAb (#6-55)
3. Normal mice
1-2. Experimental procedure
Day 0: transplantation of mouse lung cancer 3LL cells (1×$10^6$ cells subcutaneously & 5×$10^5$ cells intravenously)
Day 3: intraperitoneal administration of the antibody (first dose, corresponding to 200 µg/mouse=10 mg/kg)
Day 7: intraperitoneal administration of the antibody (second dose, corresponding to 200 µg/mouse=10 mg/kg)
Day 14: various immunological assays
1-3. Index for drug efficacy evaluation
  Effects on subcutaneous tumor growth (calculation of tumor volume by tumor size measurement)
  Ameliorating effect on mouse emaciation (measurement of mouse body weight)
  Effects on MSC expansion (CD45− cells in bone marrow or the spleen)
  Influence on immune response, etc.
  (Procedure)
  Subcutaneous tumor growth was measured 3, 5, 7, 10, and 14 days after implantation. Body weights, effects on MSC expansion, and influence on immune response were measured on day 14 in the same way as in Examples described above.
  (Results)
  As shown in FIG. 25, subcutaneous tumor growth was strongly suppressed by the administration of the anti-FSTL1 antibody, as compared with the control antibody administration group, and tumor disappeared in two out of the five mice. In this model, tumor metastasis to any organ was not macroscopically observed. 14 days after tumor implantation, the mice were too emaciated to walk, as with the bone metastasis models used in the preceding tests, even though at an early stage after tumor implantation. However, weight loss, emaciation, fluffing or the like was not observed in the anti-FSTL1 antibody administration group, and all of the mice were fine.
  On the other hand, various immunocytes including MSCs, Tregs, and MDSCs were analyzed as to tumor-infiltrating cells, bone marrow cells, and spleen cells. However, large change was seen in only CD45−ALCAM+ cells which are cancer metastasis-associated sMSCs that became a focus of attention in the bone metastasis models. Although this model was confirmed to cause no bone metastasis, sMSCs increased in number only in bone marrow and decreased in number by the administration of the anti-FSTL1 antibody. 3LL cells were also found to highly express Snail, which presumably incurred sMSC expansion.
  These results demonstrated again that FSTL1 inhibitory treatment is effective for cancer types, for example, 3LL cancer, having a common trait, such as "Snail" or "sMSCs".

It is expected that lung cancer can also be a cancer type targeted by FSTL1 antibody administration in clinical treatment.

Figure 26:
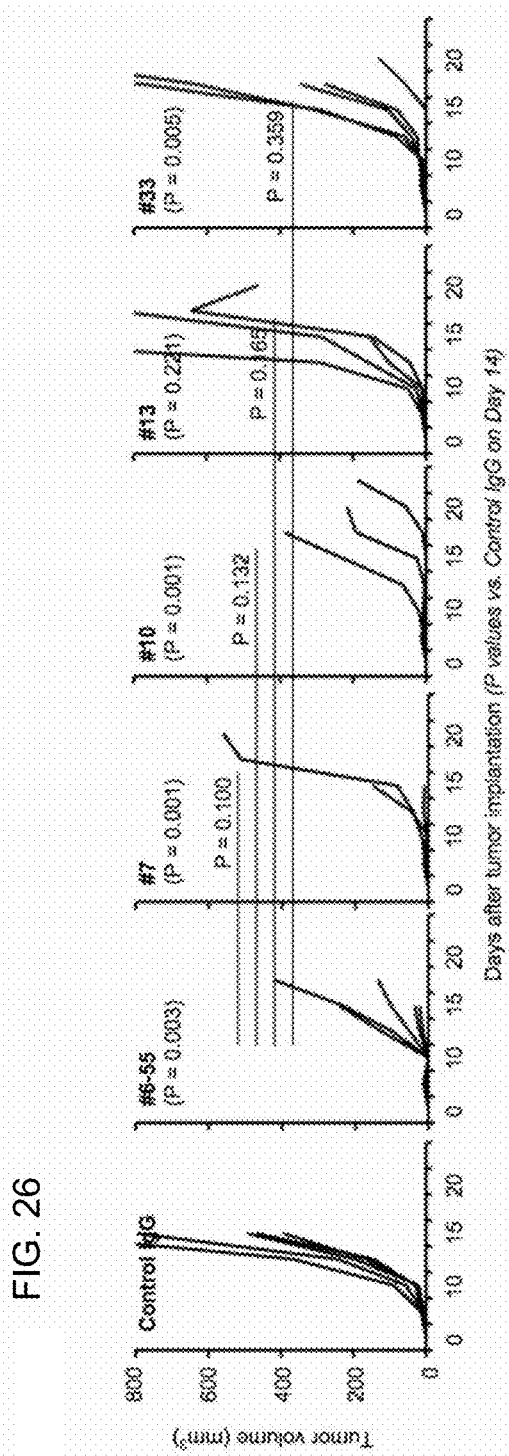
FIG. 26 FIGS. 26 and 27 show the results of evaluating the in vivo drug efficacy of each anti-FSTL1 antibody clone using Snail+ tumor bone metastasis models.
Figure 27:
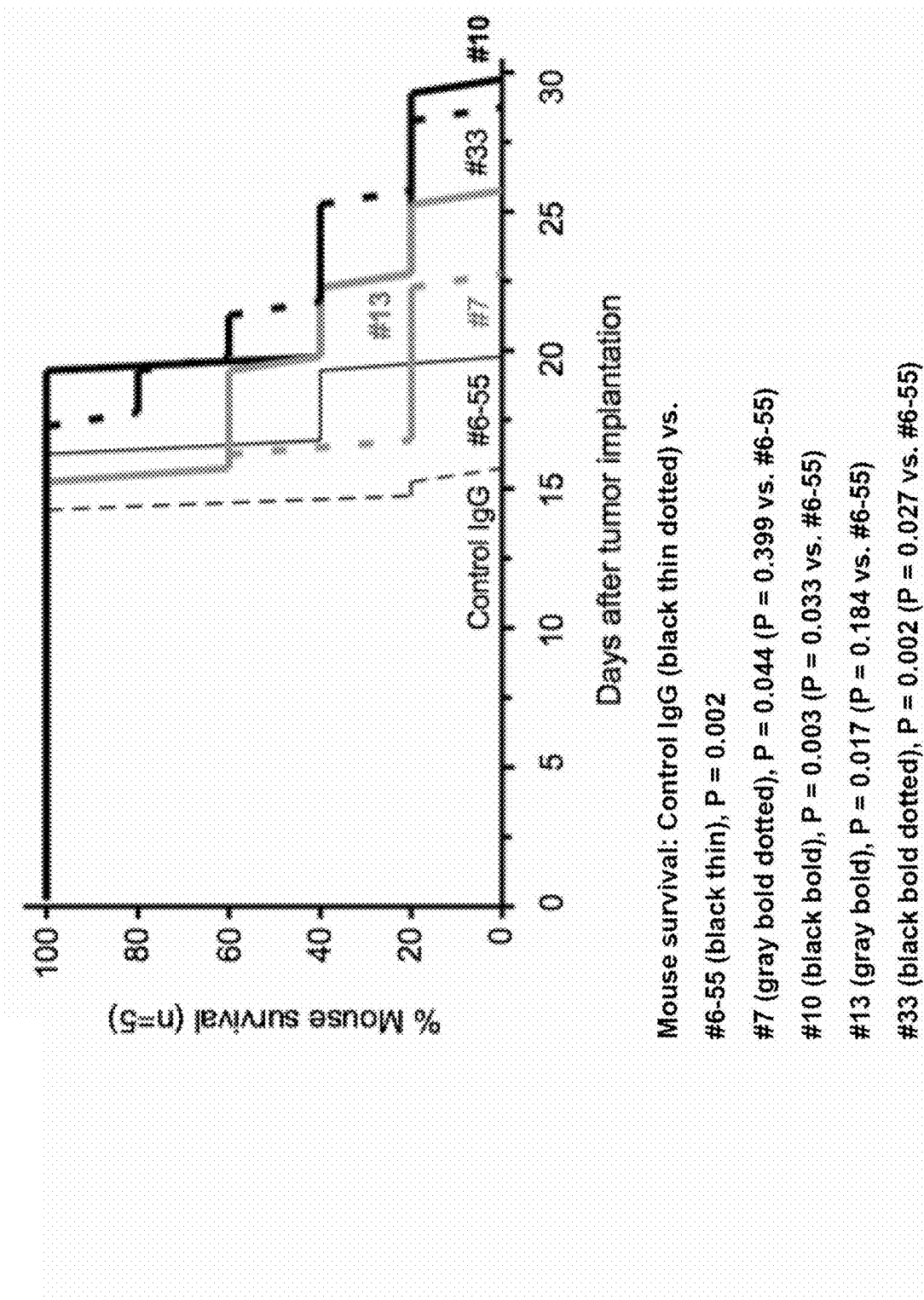

Example 32: Evaluation of In Vivo Drug Efficacy of Each Anti-FSTL1 Antibody Clone In this Example, 4 novel antibody clones confirmed to have effectiveness in the in vitro screening of drug efficacy (#7, #10, #13, and #33) were comparatively evaluated for their in vivo therapeutic effects using, as a positive control, #6-55 used in the preceding tests.
(Material and Method)
Experimental Protocol
Experiment Group (n=5)
Control IgG (anti-DNP mAb)
6-55
7
10
13
33
1-2. Experimental procedure
Day 0: transplantation of GFP+F10-snail+ tumor cells ($3\times10^5$ cells subcutaneously & $2\times10^4$ cells intravenously)
Day 4: intraperitoneal administration of the antibody (first dose, 10 mg/kg)
Day 7: intraperitoneal administration of the antibody (second dose, 10 mg/kg)
1-3. Index for drug efficacy evaluation
   Suppression of subcutaneous tumor growth
   Extension of mouse survival period
   (Procedure)
   Subcutaneous tumor was measured 4, 7, 10, 14, 17, 20, and 23 days after tumor cell transplantation.
(Results)
As shown in FIG. 26, all of the clones except for #13 exhibited statistically significant suppressive activity, as with #6-55, against subcutaneous tumor growth, as compared with the control antibody administration group, and no significant difference from #6-55 was seen. On the other hand, as shown in FIG. 27 as to the mouse survival period, all of the clones exhibited a statistically significant life-prolonging effect, as with #6-55, as compared with the control antibody administration group. Particularly, #10 and #33 exhibited therapeutic effects equal to or higher than those of #6-55. For #6-55, statistical significance is indicated at the level of $p<0.001$ of day 12 even in a test conducted at n=10. Hereinafter, the activity rank of each clone summarized on the basis of P values is shown.
Subcutaneous tumor growth suppressive effect:
7=#10>#6-55>#33>#13
Mouse life-prolonging effect:
33=#10>#6-55>#13>#7
The comprehensive evaluation of these results indicated the possibility that "#10" has high antitumor activity exceeding that of #6-55.

While a wide range of immunocytes, i.e., CD4+ cells, CD8+ cells, and NK cells, participate in antitumor immune response caused by the inhibition of FSTL1, particularly, the CD8+ cells and the NK cells, which exhibit cytotoxic activity, were also confirmed to play an essential role therein (data not shown). In general immunotherapy, antitumor effector cells are typically CD8+ T cells. NK is often regarded as a cell group of low importance that is involved in only the early stage of carcinogenesis. Rather, it has been shown that, for example, therapeutic effects are further enhanced by the removal of CD4+ T cells including Tregs or the like. On the other hand, in the FSTL1 inhibitory treatment of the present invention, various immunocytes including CD8+ cells are recruited to exert an antitumor effect. This is probably because FSTL1 and MSCs amplified by the action of FSTL1 are most upstream key factors in a cancer-associated abnormal immune mechanism, and the inhibition of FSTL1 converted MSCs as well as their various negatively controlled downstream immune responses toward antitumor ones. In other words, the original concept for development was able to be reconfirmed, and the anti-FSTL1 antibody of the present invention differs largely in the mechanism of action from conventional immunomodifying drugs and is expected to be able to serve as a novel therapeutic drug for cancer that can thoroughly improve and appropriately activate the whole host immunity.

Specifically, the inhibition of FSTL1 is presumed to inhibit the differentiation induction of MSCs and inhibit immunosuppressive cell groups (MDSCs and Tregs), thereby activating antitumor immunocyte groups. In this Example, feasibility up to the final stage was confirmed, and it is expected that a suppressor attains effects similar to those generally exhibited by an antibody, by suppressing FSTL1.

Example 33: Characterization of Mouse Chimera

In this Example, the affinity of the produced mouse chimeric antibodies for a human FSTL1 antigen was measured.
(Material and Method)
The mouse chimeric antibodies were immobilized onto Sensor Chip CM5 (GE Healthcare Japan Corp., BR-1005-30) using Mouse Antibody Capture Kit (GE Healthcare Japan Corp., BR-1008-38), and their affinity for human FSTL1 was calculated using Biacore T-200 (GE Healthcare Japan Corp.).
(Results)
First, the exhaustive activity comparison of the obtained antibodies was conducted with the human FSTL1 concentration fixed to 10 µg/ml (Table 33-1, FIG. 28).

Figure 28:
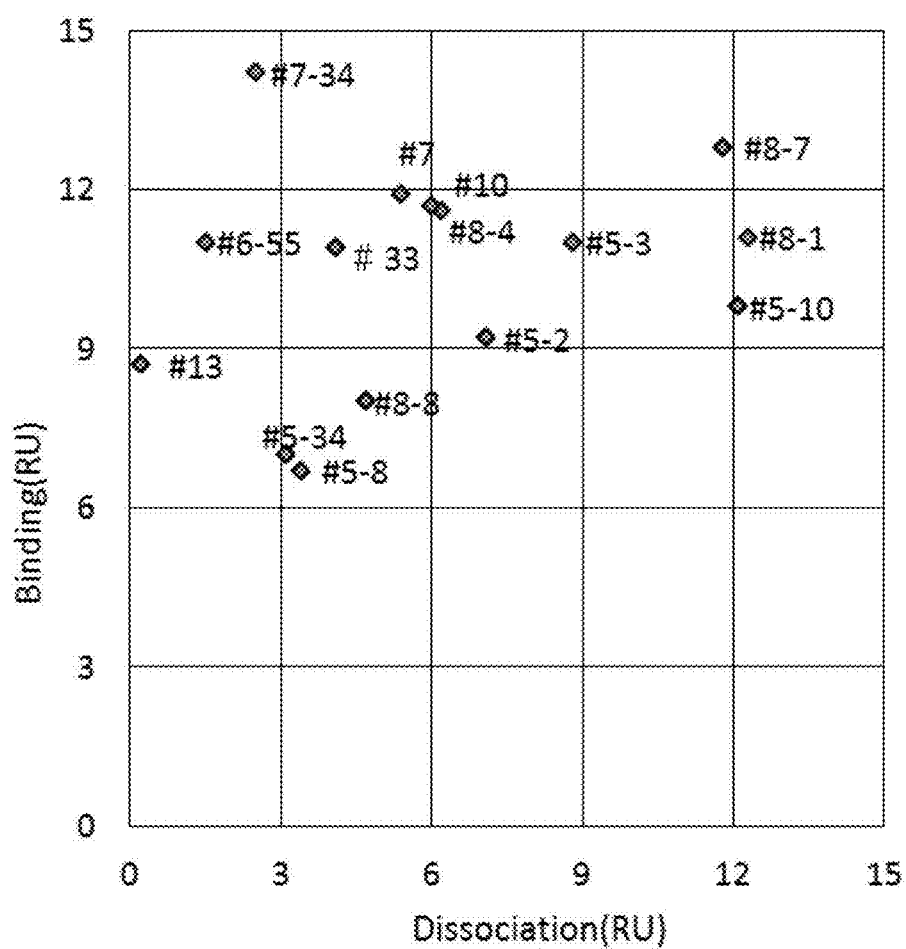
FIG. 28 shows affinity data (determined by BIACORE) on mouse chimeric antibodies. The figure is a plot of the antigen binding amounts and dissociation amounts of the mouse chimeric antibodies.

The ordinate of FIG. 28 shows the antigen binding amounts of the antibodies. The abscissa shows the antigen dissociation amounts of the antibodies. A higher antigen binding amount and a lower dissociation amount suggest affinity (position closer to the upper left of the figure means higher affinity). Next, the KD values of clone #6-55, #7-34, and #13 presumed to have high affinity in FIG. 28 were calculated with the antigen concentration adjusted to 0 to 20 µg/ml (Table 35-2). As a result, clone #6-55, #7-34, and #13 as well as #7, #10, #33, and the like were also found to have strong affinity in an assay system using surface plasmon resonance.

(Table 33-1) Antigen binding amount and dissociation amount of mouse chimeric antibody

TABLE 1-33-1

| Clone No. | Binding amount (RU) | Dissociation amount (RU) |
|---|---|---|
| #5-2 | 9.2 | 7.1 |
| #5-3 | 11 | 8.8 |
| #5-8 | 6.7 | 3.4 |
| #5-10 | 9.8 | 12.1 |
| #5-43 | 7 | 3.1 |
| #6-55 | 11 | 1.5 |
| #7-34 | 14.2 | 2.5 |
| #8-1 | 11.1 | 12.3 |
| #8-4 | 11.6 | 6.2 |

TABLE 1-33-1-continued

| Clone No. | Binding amount (RU) | Dissociation amount (RU) |
|---|---|---|
| #8-7 | 12.8 | 11.8 |
| #8-8 | 8 | 4.7 |
| #7 | 11.9 | 5.4 |
| #10 | 11.7 | 6 |
| #13 | 8.7 | 0.2 |
| #33 | 10.9 | 4.1 |

(Table 33-2) KD value of mouse chimeric antibody

TABLE 1-33-2

| Clone No. | $K_D$ (M) |
|---|---|
| #6-55 | $2.43 \times 10^8$ |
| #7-34 | $1.22 \times 10^8$ |
| #13 | $1.12 \times 10^8$ |

Example 34: Development and Affinity Measurement of Humanized Antibody

<Affinity of Humanized Antibody: Measurement Using Biacore T-200>

In this Example, humanized antibodies were developed, and the affinity of the developed antibodies for human FSTL1 was measured.

(Material and Method)

Nine IgG1-type humanized antibodies of #6-55 were immobilized onto Sensor Chip CM5 (GE Healthcare Japan Corp., BR-1005-30) using Human Antibody Capture Kit (GE Healthcare Japan Corp., BR-1008-38), and their affinity for human FSTL1 was calculated using Biacore T-200 (GE Healthcare Japan Corp.). The KD values were calculated with the antigen concentration adjusted to 0 to 20 μg/ml (Table 34-1). Among the 9 IgG1-type humanized antibodies of #6-55, a clone composed of a combination "H(2)-L(1)" having a high KD value was selected as a lead antibody.

(Table 34-1) Table. Affinity (KD value) comparison based on combination of H chain and L chain of humanized 6-55 antibody (IgG1 type)

TABLE 1-34-1

| h #6-55 | H(1)-L(1) | H(1)-L(2) | H(3)-L(1) | H(3)-L(1) | H(2)-L(1) | H(2)-L(2) | H(1)-L(3) | H(2)-L(3) | H(3)-L(3) |
|---|---|---|---|---|---|---|---|---|---|
| KD value (M) | $3.52 \times 10^{-8}$ | $2.50 \times 10^{-8}$ | $2.67 \times 10^{-8}$ | $3.35 \times 10^{-8}$ | $6.05 \times 10^{-8}$ | $1.13 \times 10^{-8}$ | $2.68 \times 10^{-8}$ | $4.50 \times 10^{-8}$ | $2.49 \times 10^{-8}$ |

<Preparation of Humanized Antibody>

Figure 29:
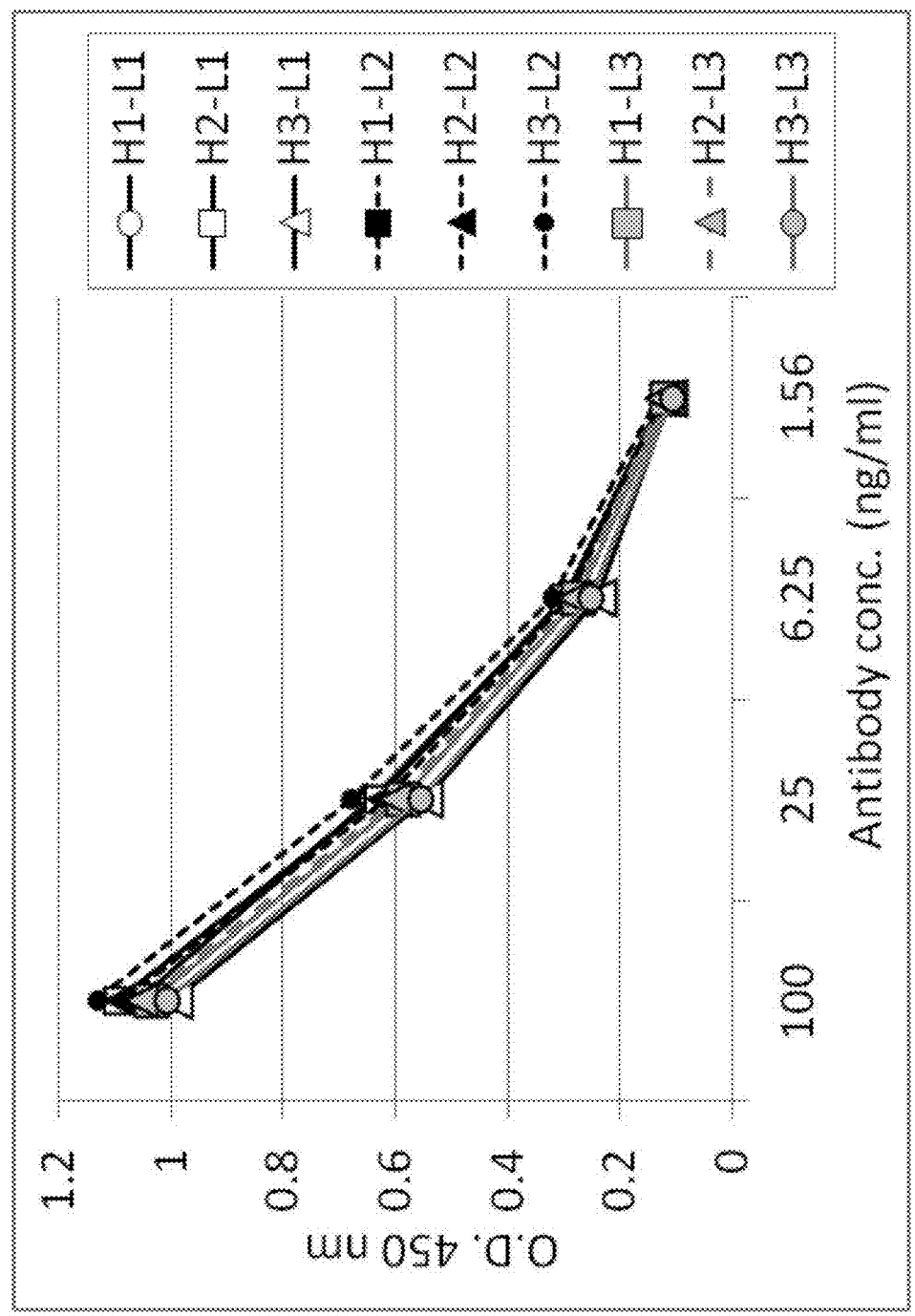
FIG. 29 FIGS. 29 and 30 show ELISA results of humanized antibodies.

On the basis of the report of Matsuda et al., Molecular Immunology 43 (2006) 634-642, a gene was designed such that frame regions present in the H chain and L chain variable regions of clone #6-55 were substituted by human sequences from the chicken sequences. The gene was synthesized. 3 types each of H chains and L chains per clone were designed and synthesized (humanized H chains (1), (2), and (3), and humanized L chains (1), (2), and (3); H chain (1) is also referred to as H(1), H1, etc., and it is understood that all of these terms refer to the same clone; the same holds true for H chain (2), H chain (3), and L chains (1), (2), and (3)). The full-length sequence of the H(1) heavy chain is represented by SEQ ID NOs: 192 and 193 (which represent nucleic acid and amino acid sequences, respectively) for IgG1 type and represented by SEQ ID NOs: 198 and 199 (which represent nucleic acid and amino acid sequences, respectively) for IgG4 type. The full-length sequence of the H(2) heavy chain is represented by SEQ ID NOs: 194 and 195 (which represent nucleic acid and amino acid sequences, respectively) for IgG1 type and represented by SEQ ID NOs: 200 and 201 (which represent nucleic acid and amino acid sequences, respectively) for IgG4 type. The full-length sequence of the H(3) heavy chain is represented by SEQ ID NOs: 196 and 197 (which represent nucleic acid and amino acid sequences, respectively) for IgG1 type and represented by SEQ ID NOs: 202 and 203 (which represent nucleic acid and amino acid sequences, respectively) for IgG4 type. The full-length sequence of the L(1) light chain is represented by SEQ ID NOs: 204 and 205 (which represent nucleic acid and amino acid sequences, respectively). The full-length sequence of the L(2) light chain is represented by SEQ ID NOs: 246 and 247 (which represent nucleic acid and amino acid sequences, respectively). The full-length sequence of the L(3) light chain is represented by SEQ ID NOs: 248 and 249 (which represent nucleic acid and amino acid sequences, respectively). The synthesized variable region genes were amplified by PCR, then treated with restriction enzymes, and transferred to L chain or H chain expression cassette vectors (restriction enzyme-treated vectors) having gene inserts of a chicken antibody leader sequence and a human IgG1 constant region. HEK293 cells were transfected with 9 types in total of combinations of the constructed H chain (1) to (3) and L chain (1) to (3) expression vectors for the clones, and humanized antibodies were purified from culture supernatants using Protein A Sepharose. As a result of conducting ELISA in order to confirm the binding activity of the purified IgG1-type humanized antibodies against human FSTL1, all of the clones were able to be confirmed to have binding activity to a given extent (FIG. 29). Among them, the humanized clone of H(2)-L(1) exhibited a numerical value higher by an order of magnitude as compared with other clones (see Table 34-1). Therefore, this clone was used in the next experiment.

<Binding Activity of Humanized Antibody: ELISA>

Figure 30:
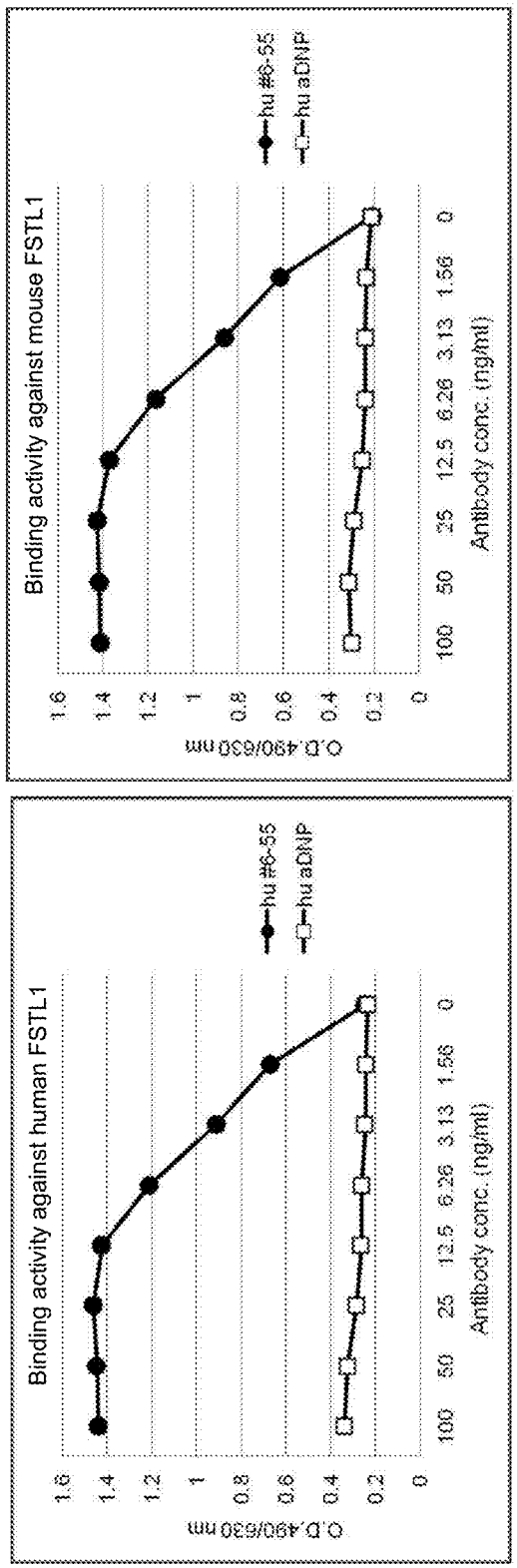

The binding activity of the purified antibody of IgG1-type humanized #6-55 H chain (2)+L chain (1) against human FSTL1 and mouse FSTL1 was confirmed by ELISA (FIG. 30). From the results of FIG. 30, it was able to be confirmed that the antibody of the present invention has similar binding activity against human FSTL1 and mouse FSTL1 and retains activity against human FSTL1.

The present invention is illustrated above by using the preferred embodiments of the present invention. However, it is understood that the scope of the present invention should be interpreted only by claims. It is understood that the contents of patents, patent applications, and literatures cited herein are incorporated herein by reference similarly to the specific description of the contents themselves in the present specification.

INDUSTRIAL APPLICABILITY

The present invention provides prophylactic and therapeutic agent for cancer and techniques of suppressing metastasis, particularly, bone metastasis, by the mitigation of immune defect such as immunosuppression. The present invention provides techniques available in industry (reagents, pharmaceutical industry, etc.) involved in techniques related to cancer treatment and prevention.

[Free Text of Sequence Listing]
SEQ ID NO: 1: Nucleic acid sequence of human FSTL1
SEQ ID NO: 2: Amino acid sequence of human FSTL1
SEQ ID NO: 3: Nucleic acid sequence of mouse FSTL1
SEQ ID NO: 4: Amino acid sequence of mouse FSTL1
SEQ ID NO: 5: Nucleic acid sequence of the light chain variable region of antibody clone #5-2
SEQ ID NO: 6: Amino acid sequence of the light chain variable region of antibody clone #5-2
SEQ ID NO: 7: Nucleic acid sequence of the heavy chain variable region of antibody clone #5-2
SEQ ID NO: 8: Amino acid sequence of the heavy chain variable region of antibody clone #5-2
SEQ ID NO: 9: Nucleic acid sequence of the light chain variable region of antibody clone #5-3
SEQ ID NO: 10: Amino acid sequence of the light chain variable region of antibody clone #5-3
SEQ ID NO: 11: Nucleic acid sequence of the heavy chain variable region of antibody clone #5-3
SEQ ID NO: 12: Amino acid sequence of the heavy chain variable region of antibody clone #5-3
SEQ ID NO: 13: Nucleic acid sequence of the light chain variable region of antibody clone #5-8
SEQ ID NO: 14: Amino acid sequence of the light chain variable region of antibody clone #5-8
SEQ ID NO: 15: Nucleic acid sequence of the heavy chain variable region of antibody clone #5-8
SEQ ID NO: 16: Amino acid sequence of the heavy chain variable region of antibody clone #5-8
SEQ ID NO: 17: Nucleic acid sequence of the light chain variable region of antibody clone #5-10
SEQ ID NO: 18: Amino acid sequence of the light chain variable region of antibody clone #5-10
SEQ ID NO: 19: Nucleic acid sequence of the heavy chain variable region of antibody clone #5-10
SEQ ID NO: 20: Amino acid sequence of the heavy chain variable region of antibody clone #5-10
SEQ ID NO: 21: Nucleic acid sequence of the light chain variable region of antibody clone #5-43
SEQ ID NO: 22: Amino acid sequence of the light chain variable region of antibody clone #5-43
SEQ ID NO: 23: Nucleic acid sequence of the heavy chain variable region of antibody clone #5-43
SEQ ID NO: 24: Amino acid sequence of the heavy chain variable region of antibody clone #5-43
SEQ ID NO: 25: Nucleic acid sequence of the light chain variable region of antibody clone #6-55
SEQ ID NO: 26: Amino acid sequence of the light chain variable region of antibody clone #6-55
SEQ ID NO: 27: Nucleic acid sequence of the heavy chain variable region of antibody clone #6-55
SEQ ID NO: 28: Amino acid sequence of the heavy chain variable region of antibody clone #6-55
SEQ ID NO: 29: Nucleic acid sequence of the light chain variable region of antibody clone #7-34
SEQ ID NO: 30: Amino acid sequence of the light chain variable region of antibody clone #7-34
SEQ ID NO: 31: Nucleic acid sequence of the heavy chain variable region of antibody clone #7-34
SEQ ID NO: 32: Amino acid sequence of the heavy chain variable region of antibody clone #7-34
SEQ ID NO: 33: Nucleic acid sequence of the light chain variable region of antibody clone #8-1
SEQ ID NO: 34: Amino acid sequence of the light chain variable region of antibody clone #8-1
SEQ ID NO: 35: Nucleic acid sequence of the heavy chain variable region of antibody clone #8-1
SEQ ID NO: 36: Amino acid sequence of the heavy chain variable region of antibody clone #8-1
SEQ ID NO: 37: Nucleic acid sequence of the light chain variable region of antibody clone #8-4
SEQ ID NO: 38: Amino acid sequence of the light chain variable region of antibody clone #8-4
SEQ ID NO: 39: Nucleic acid sequence of the heavy chain variable region of antibody clone #8-4
SEQ ID NO: 40: Amino acid sequence of the heavy chain variable region of antibody clone #8-4
SEQ ID NO: 41: Nucleic acid sequence of the light chain variable region of antibody clone #8-7
SEQ ID NO: 42: Amino acid sequence of the light chain variable region of antibody clone #8-7
SEQ ID NO: 43: Nucleic acid sequence of the heavy chain variable region of antibody clone #8-7
SEQ ID NO: 44: Amino acid sequence of the heavy chain variable region of antibody clone #8-7
SEQ ID NO: 45: Nucleic acid sequence of the light chain variable region of antibody clone #8-8
SEQ ID NO: 46: Amino acid sequence of the light chain variable region of antibody clone #8-8
SEQ ID NO: 47: Nucleic acid sequence of the heavy chain variable region of antibody clone #8-8
SEQ ID NO: 48: Amino acid sequence of the heavy chain variable region of antibody clone #8-8
SEQ ID NO: 49: Nucleic acid sequence of the light chain variable region of antibody clone #7
SEQ ID NO: 50: Amino acid sequence of the light chain variable region of antibody clone #7
SEQ ID NO: 51: Nucleic acid sequence of the heavy chain variable region of antibody clone #7
SEQ ID NO: 52: Amino acid sequence of the heavy chain variable region of antibody clone #7
SEQ ID NO: 53: Nucleic acid sequence of the light chain variable region of antibody clone #10
SEQ ID NO: 54: Amino acid sequence of the light chain variable region of antibody clone #10
SEQ ID NO: 55: Nucleic acid sequence of the heavy chain variable region of antibody clone #10
SEQ ID NO: 56: Amino acid sequence of the heavy chain variable region of antibody clone #10
SEQ ID NO: 57: Nucleic acid sequence of the light chain variable region of antibody clone #13
SEQ ID NO: 58: Amino acid sequence of the light chain variable region of antibody clone #13
SEQ ID NO: 59: Nucleic acid sequence of the heavy chain variable region of antibody clone #13
SEQ ID NO: 60: Amino acid sequence of the heavy chain variable region of antibody clone #13
SEQ ID NO: 61: Nucleic acid sequence of the light chain variable region of antibody clone #22
SEQ ID NO: 62: Amino acid sequence of the light chain variable region of antibody clone #22
SEQ ID NO: 63: Nucleic acid sequence of the heavy chain variable region of antibody clone #22

SEQ ID NO: 64: Amino acid sequence of the heavy chain variable region of antibody clone #22
SEQ ID NO: 65: Nucleic acid sequence of the light chain variable region of antibody clone #33
SEQ ID NO: 66: Amino acid sequence of the light chain variable region of antibody clone #33
SEQ ID NO: 67: Nucleic acid sequence of the heavy chain variable region of antibody clone #33
SEQ ID NO: 68: Amino acid sequence of the heavy chain variable region of antibody clone #33
SEQ ID NO: 69: Nucleic acid sequence of FSTL1 used in Examples (human; human FSTL1 gene after codon optimization+sequence with sequences for recombination added at both ends+C-terminally 3×alanine+6×histidine-added sequence)
SEQ ID NO: 70: Amino acid sequence of FSTL1 used in Examples (human; human FSTL1 gene after codon optimization+sequence with sequences for recombination added at both ends+C-terminally 3×alanine+6×histidine-added sequence)
SEQ ID NO: 71: Nucleic acid sequence of FSTL1 used in Examples (mouse; mouse FSTL1 gene after codon optimization+sequence with sequences for recombination added at both ends+C-terminally 3×alanine+6×histidine-added sequence)
SEQ ID NO: 72: Amino acid sequence of FSTL1 used in Examples (mouse; mouse FSTL1 gene after codon optimization+sequence with sequences for recombination (red) added at both ends+C-terminally 3×alanine+6×histidine-added sequence)
SEQ ID NO: 73: MCS sequence
SEQ ID NO: 74: MCS sequence (complementary chain)
SEQ ID NO: 75: Sequence for insertion
SEQ ID NO: 76: Sequence for insertion
SEQ ID NO: 77: Δ21-53 (Forward primer)
SEQ ID NO: 78: Δ21-53 (Reverse primer)
SEQ ID NO: 79: Δ100-140 (Forward primer)
SEQ ID NO: 80: Δ100-140 (Reverse primer)
SEQ ID NO: 81: Δ148-170 (Forward primer)
SEQ ID NO: 82: Δ148-170 (Reverse primer)
SEQ ID NO: 83: Δ181-190 (Forward primer)
SEQ ID NO: 84: Δ181-190 (Reverse primer)
SEQ ID NO: 85: Δ193-228 (Forward primer)
SEQ ID NO: 86: Δ193-228 (Reverse primer)
SEQ ID NO: 87: Δ233-289 (Forward primer)
SEQ ID NO: 88: Δ233-289 (Reverse primer)
SEQ ID NO: 89: Δ148-154 (Forward primer)
SEQ ID NO: 90: Δ148-154 (Reverse primer)
SEQ ID NO: 91: Δ155-162 (Forward primer)
SEQ ID NO: 92: Δ155-162 (Reverse primer)
SEQ ID NO: 93: Δ163-170 (Forward primer)
SEQ ID NO: 94: Δ163-170 (Reverse primer)
SEQ ID NO: 95: Full-length nucleic acid sequence of the light chain of antibody clone #5-2
SEQ ID NO: 96: Full-length amino acid sequence of the light chain of antibody clone #5-2
SEQ ID NO: 97: Full-length nucleic acid sequence of the heavy chain of antibody clone #5-2
SEQ ID NO: 98: Full-length amino acid sequence of the heavy chain of antibody clone #5-2
SEQ ID NO: 99: Full-length nucleic acid sequence of the light chain of antibody clone #5-3
SEQ ID NO: 100: Full-length amino acid sequence of the light chain of antibody clone #5-3
SEQ ID NO: 101: Full-length nucleic acid sequence of the heavy chain of antibody clone #5-3
SEQ ID NO: 102: Full-length amino acid sequence of the heavy chain of antibody clone #5-3
SEQ ID NO: 103: Full-length nucleic acid sequence of the light chain of antibody clone #5-8
SEQ ID NO: 104: Full-length amino acid sequence of the light chain of antibody clone #5-8
SEQ ID NO: 105: Full-length nucleic acid sequence of the heavy chain of antibody clone #5-8
SEQ ID NO: 106: Full-length amino acid sequence of the heavy chain of antibody clone #5-8
SEQ ID NO: 107: Full-length nucleic acid sequence of the light chain of antibody clone #5-10
SEQ ID NO: 108: Full-length amino acid sequence of the light chain of antibody clone #5-10
SEQ ID NO: 109: Full-length nucleic acid sequence of the heavy chain of antibody clone #5-10
SEQ ID NO: 110: Full-length amino acid sequence of the heavy chain of antibody clone #5-10
SEQ ID NO: 111: Full-length nucleic acid sequence of the light chain of antibody clone #5-43
SEQ ID NO: 112: Full-length amino acid sequence of the light chain of antibody clone #5-43
SEQ ID NO: 113: Full-length nucleic acid sequence of the heavy chain of antibody clone #5-43
SEQ ID NO: 114: Full-length amino acid sequence of the heavy chain of antibody clone #5-43
SEQ ID NO: 115: Full-length nucleic acid sequence of the light chain of antibody clone #6-55
SEQ ID NO: 116: Full-length amino acid sequence of the light chain of antibody clone #6-55
SEQ ID NO: 117: Full-length nucleic acid sequence of antibody clone #6-55
SEQ ID NO: 118: Full-length amino acid sequence of antibody clone #6-55
SEQ ID NO: 119: Full-length nucleic acid sequence of the light chain of antibody clone #7-34
SEQ ID NO: 120: Full-length amino acid sequence of the light chain of antibody clone #7-34
SEQ ID NO: 121: Full-length nucleic acid sequence of the heavy chain of antibody clone #7-34
SEQ ID NO: 122: Full-length amino acid sequence of the heavy chain of antibody clone #7-34
SEQ ID NO: 123: Full-length nucleic acid sequence of the light chain of antibody clone #8-1
SEQ ID NO: 124: Full-length amino acid sequence of the light chain of antibody clone #8-1
SEQ ID NO: 125: Full-length nucleic acid sequence of the heavy chain of antibody clone #8-1
SEQ ID NO: 126: Full-length amino acid sequence of the heavy chain of antibody clone #8-1
SEQ ID NO: 127: Full-length nucleic acid sequence of the light chain of antibody clone #8-4
SEQ ID NO: 128: Full-length amino acid sequence of the light chain of antibody clone #8-4
SEQ ID NO: 129: Full-length nucleic acid sequence of the heavy chain of antibody clone #8-4
SEQ ID NO: 130: Full-length amino acid sequence of the heavy chain of antibody clone #8-4
SEQ ID NO: 131: Full-length nucleic acid sequence of the light chain of antibody clone #8-7
SEQ ID NO: 132: Full-length amino acid sequence of the light chain of antibody clone #8-7
SEQ ID NO: 133: Full-length nucleic acid sequence of the heavy chain of antibody clone #8-7
SEQ ID NO: 134: Full-length amino acid sequence of the heavy chain of antibody clone #8-7

SEQ ID NO: 135: Full-length nucleic acid sequence of the light chain of antibody clone #8-8
SEQ ID NO: 136: Full-length amino acid sequence of the light chain of antibody clone #8-8
SEQ ID NO: 137: Full-length nucleic acid sequence of the heavy chain of antibody clone #8-8
SEQ ID NO: 138: Full-length amino acid sequence of the heavy chain of antibody clone #8-8
SEQ ID NO: 139: Full-length nucleic acid sequence of the light chain of antibody clone #7
SEQ ID NO: 140: Full-length amino acid sequence of the light chain of antibody clone #7
SEQ ID NO: 141: Full-length nucleic acid sequence of the heavy chain of antibody clone #7
SEQ ID NO: 142: Full-length amino acid sequence of the heavy chain of antibody clone #7
SEQ ID NO: 143: Full-length nucleic acid sequence of the light chain of antibody clone #10
SEQ ID NO: 144: Full-length amino acid sequence of the light chain of antibody clone #10
SEQ ID NO: 145: Full-length nucleic acid sequence of the heavy chain of antibody clone #10
SEQ ID NO: 146: Full-length amino acid sequence of the heavy chain of antibody clone #10
SEQ ID NO: 147: Full-length nucleic acid sequence of the light chain of antibody clone #13
SEQ ID NO: 148: Full-length amino acid sequence of the light chain of antibody clone #13
SEQ ID NO: 149: Full-length nucleic acid sequence of the heavy chain of antibody clone #13
SEQ ID NO: 150: Full-length amino acid sequence of the heavy chain of antibody clone #13
SEQ ID NO: 151: Full-length nucleic acid sequence of the light chain of antibody clone #22
SEQ ID NO: 152: Full-length amino acid sequence of the light chain of antibody clone #22
SEQ ID NO: 153: Full-length nucleic acid sequence of the heavy chain of antibody clone #22
SEQ ID NO: 154: Full-length amino acid sequence of the heavy chain of antibody clone #22
SEQ ID NO: 155: Full-length nucleic acid sequence of the light chain of antibody clone #33
SEQ ID NO: 156: Full-length amino acid sequence of the light chain of antibody clone #33
SEQ ID NO: 157: Full-length nucleic acid sequence of the heavy chain of antibody clone #33
SEQ ID NO: 158: Full-length amino acid sequence of the heavy chain of antibody clone #33
SEQ ID NO: 159: Amino acid sequence of FSTL1 of Novoprotein
SEQ ID NO: 160: Nucleic acid sequence of framework 1 of the H(1) heavy chain of a humanized sequence
SEQ ID NO: 161: Amino acid sequence of framework 1 of the H(1) heavy chain of the humanized sequence
SEQ ID NO: 162: Nucleic acid sequence of framework 2 of the H(1) heavy chain of the humanized sequence
SEQ ID NO: 163: Amino acid sequence of framework 2 of the H(1) heavy chain of the humanized sequence
SEQ ID NO: 164: Nucleic acid sequence of framework 3 of the H(1) heavy chain of the humanized sequence
SEQ ID NO: 165: Amino acid sequence of framework 3 of the H(1) heavy chain of the humanized sequence
SEQ ID NO: 166: Nucleic acid sequence of framework 4 of the H(1) heavy chain of the humanized sequence
SEQ ID NO: 167: Amino acid sequence of framework 4 of the H(1) heavy chain of the humanized sequence
SEQ ID NO: 168: Nucleic acid sequence of framework 1 of the H(2) heavy chain of a humanized sequence
SEQ ID NO: 169: Amino acid sequence of framework 1 of the H(2) heavy chain of the humanized sequence
SEQ ID NO: 170: Nucleic acid sequence of framework 2 of the H(2) heavy chain of the humanized sequence
SEQ ID NO: 171: Amino acid sequence of framework 2 of the H(2) heavy chain of the humanized sequence
SEQ ID NO: 172: Nucleic acid sequence of framework 3 of the H(2) heavy chain of the humanized sequence
SEQ ID NO: 173: Amino acid sequence of framework 3 of the H(2) heavy chain of the humanized sequence
SEQ ID NO: 174: Nucleic acid sequence of framework 4 of the H(2) heavy chain of the humanized sequence
SEQ ID NO: 175: Amino acid sequence of framework 4 of the H(2) heavy chain of the humanized sequence
SEQ ID NO: 176: Nucleic acid sequence of framework 1 of the H(3) heavy chain of a humanized sequence
SEQ ID NO: 177: Amino acid sequence of framework 1 of the H(3) heavy chain of the humanized sequence
SEQ ID NO: 178: Nucleic acid sequence of framework 2 of the H(3) heavy chain of the humanized sequence
SEQ ID NO: 179: Amino acid sequence of framework 2 of the H(3) heavy chain of the humanized sequence
SEQ ID NO: 180: Nucleic acid sequence of framework 3 of the H(3) heavy chain of the humanized sequence
SEQ ID NO: 181: Amino acid sequence of framework 3 of the H(3) heavy chain of the humanized sequence
SEQ ID NO: 182: Nucleic acid sequence of framework 4 of the H(3) heavy chain of the humanized sequence
SEQ ID NO: 183: Amino acid sequence of framework 4 of the H(3) heavy chain of the humanized sequence
SEQ ID NO: 184: Nucleic acid sequence of framework 1 of the L(1) light chain of a humanized sequence
SEQ ID NO: 185: Amino acid sequence of framework 1 of the L(1) light chain of the humanized sequence
SEQ ID NO: 186: Nucleic acid sequence of framework 2 of the L(1) light chain of the humanized sequence
SEQ ID NO: 187: Amino acid sequence of framework 2 of the L(1) light chain of the humanized sequence
SEQ ID NO: 188: Nucleic acid sequence of framework 3 of the L(1) light chain of the humanized sequence
SEQ ID NO: 189: Amino acid sequence of framework 3 of the L(1) light chain of the humanized sequence
SEQ ID NO: 190: Nucleic acid sequence of framework 4 of the L(1) light chain of the humanized sequence
SEQ ID NO: 191: Amino acid sequence of framework 4 of the L(1) light chain of the humanized sequence
SEQ ID NO: 192: Full-length nucleic acid sequence of the IgG1-type H(1) heavy chain of a humanized sequence
SEQ ID NO: 193: Full-length amino acid sequence of the IgG1-type H(1) heavy chain of the humanized sequence
SEQ ID NO: 194: Full-length nucleic acid sequence of the IgG1-type H(2) heavy chain of a humanized sequence
SEQ ID NO: 195: Full-length amino acid sequence of the IgG1-type H(2) heavy chain of the humanized sequence
SEQ ID NO: 196: Full-length nucleic acid sequence of the IgG1-type H(3) heavy chain of a humanized sequence
SEQ ID NO: 197: Full-length amino acid sequence of the IgG1-type H(3) heavy chain of the humanized sequence
SEQ ID NO: 198: Full-length nucleic acid sequence of the IgG4-type H(1) heavy chain of a humanized sequence
SEQ ID NO: 199: Full-length amino acid sequence of the IgG4-type H(1) heavy chain of the humanized sequence
SEQ ID NO: 200: Full-length nucleic acid sequence of the IgG4 H(2) heavy chain of a humanized sequence SEQ ID NO: 201: Full-length amino acid sequence of the IgG4 H(2) heavy chain of the humanized sequence
SEQ ID NO: 202: Full-length nucleic acid sequence of the IgG4 H(3) heavy chain of a humanized sequence
SEQ ID NO: 203: Full-length amino acid sequence of the IgG4 H(3) heavy chain of the humanized sequence
SEQ ID NO: 204: Full-length nucleic acid sequence of the L(1) light chain of a humanized sequence
SEQ ID NO: 205: Full-length amino acid sequence of the L(1) light chain of a humanized sequence
SEQ ID NO: 206: Amino acid sequence of heavy chain sequence framework 1 of a chicken sequence for reference
SEQ ID NO: 207: Amino acid sequence of heavy chain sequence framework 2 of the chicken sequence for reference
SEQ ID NO: 208: Amino acid sequence of heavy chain sequence framework 3 of the chicken sequence for reference
SEQ ID NO: 209: Amino acid sequence of heavy chain sequence framework 4 of the chicken sequence for reference
SEQ ID NO: 210: Amino acid sequence of light chain sequence framework 1 of the chicken sequence for reference
SEQ ID NO: 211: Amino acid sequence of light chain sequence framework 2 of the chicken sequence for reference
SEQ ID NO: 212: Amino acid sequence of light chain sequence framework 3 of the chicken sequence for reference
SEQ ID NO: 213: Amino acid sequence of light chain sequence framework 4 of the chicken sequence for reference
SEQ ID NO: 214: Alternative amino acid sequence of light chain sequence framework 2 of the chicken sequence for reference
SEQ ID NO: 215: Alternative amino acid sequence of light chain sequence framework 3 of the chicken sequence for reference
SEQ ID NO: 216: Δ193-204 (Forward primer)
SEQ ID NO: 217: Δ193-204 (Reverse primer)
SEQ ID NO: 218: Δ205-216 (Forward primer)
SEQ ID NO: 219: Δ205-216 (Reverse primer)
SEQ ID NO: 220: Δ217-228 (Forward primer)
SEQ ID NO: 221: Δ217-228 (Reverse primer)
SEQ ID NO: 222: Δ233-251 (Forward primer)
SEQ ID NO: 223: Δ233-251 (Reverse primer)
SEQ ID NO: 224: Δ252-270 (Forward primer)
SEQ ID NO: 225: Δ252-270 (Reverse primer)
SEQ ID NO: 226: Δ271-289 (Forward primer)
SEQ ID NO: 227: Δ271-289 (Reverse primer)
SEQ ID NO: 228: Δ48-100 (Forward primer)
SEQ ID NO: 229: Δ48-100 (Reverse primer)
SEQ ID NO: 230: Nucleic acid sequence of framework 1 of the L(2) light chain of a humanized sequence
SEQ ID NO: 231: Amino acid sequence of framework 1 of the L(2) light chain of the humanized sequence
SEQ ID NO: 232: Nucleic acid sequence of framework 2 of the L(2) light chain of the humanized sequence
SEQ ID NO: 233: Amino acid sequence of framework 2 of the L(2) light chain of the humanized sequence
SEQ ID NO: 234: Nucleic acid sequence of framework 3 of the L(2) light chain of the humanized sequence
SEQ ID NO: 235: Amino acid sequence of framework 3 of the L(2) light chain of the humanized sequence
SEQ ID NO: 236: Nucleic acid sequence of framework 4 of the L(2) light chain of the humanized sequence
SEQ ID NO: 237: Amino acid sequence of framework 4 of the L(2) light chain of the humanized sequence
SEQ ID NO: 238: Nucleic acid sequence of framework 1 of the L(3) light chain of humanized sequence
SEQ ID NO: 239: Amino acid sequence of framework 1 of the L(3) light chain of humanized sequence
SEQ ID NO: 240: Nucleic acid sequence of framework 2 of the L(3) light chain of humanized sequence
SEQ ID NO: 241: Amino acid sequence of framework 2 of the L(3) light chain of humanized sequence
SEQ ID NO: 242: Nucleic acid sequence of framework 3 of the L(3) light chain of humanized sequence
SEQ ID NO: 243: Amino acid sequence of framework 3 of the L(3) light chain of humanized sequence
SEQ ID NO: 244: Nucleic acid sequence of framework 4 of the L(3) light chain of humanized sequence
SEQ ID NO: 245: Amino acid sequence of framework 4 of the L(3) light chain of humanized sequence
SEQ ID NO: 246: Full-length nucleic acid sequence of the L(2) light chain of the humanized sequence
SEQ ID NO: 247: Full-length amino acid sequence of the L(2) light chain of the humanized sequence
SEQ ID NO: 248: Full-length nucleic acid sequence of the L(3) light chain of the humanized sequence
SEQ ID NO: 249: Full-length amino acid sequence of the L(3) light chain of the humanized sequence
<Part 2>

TECHNICAL FIELD

The present invention relates to a combination drug for treatment of malignant tumor, etc.

BACKGROUND ART

Immunosuppression has been known as a cause of aggravation of cancer. The mitigation of immunosuppression reportedly leads to the effective treatment of cancer. Thus, approaches therefor are under development.

Patent Literature 1 has reported molecules associated with the mitigation of immunosuppression. Although FSTL1 has been studied to some extent (Non Patent Literatures 1 and 2), much is still unknown about its functions.

Techniques of the mitigation of immunosuppression are still evolving. Cancer patients have in vivo host immunity, which attempts to attack and eliminate cancer. On the other hand, cancer cells are known to possess a system that attempts to circumvent control of the host immunity. For example, it has been found in vitro and in vivo that immune response to cancer cells is changed by removing regulatory T cells in the presence of the cancer cells (see Non Patent Literature 3=Andaloussi and Lesniak Neuro-Oncology 8, 234-243, 2006). Regulatory T cells increase in number in stomach cancer (see Non Patent Literature 4=Ichihara et al., Clin. Cancer Res. 9, 4404-4408, 2003; and Non Patent Literature 5=Wolf et al., Clin. Cancer Res. 9, 606-612, 2003), rectal cancer (see Non Patent Literature 6=Hicky et al., Semin. Immunol. 11, 125-137, 1999), pancreatic cancer (see Non Patent Literature 7=Liyanage et al., J. Immunol. 169, 2756-2761, 2002; and Non Patent Literature 8=Sasada et al., Cancer 98, 1098-1099, 2003), lung cancer (see Non Patent Literature 9=Woo et al., Cancer Res. 61, 4766-4772, 2001), and glioma (see Non Patent Literature 3=Andaloussi and Lesniak Neuro-Oncology 8, 234-243, 2006), suggesting that the regulatory T cells are involved in the immune escape system of cancer cells. However, the mechanism underlying this is unknown, and the manner in which regulatory T cell-derived cytokines contribute remains a subject of dispute (see Non Patent Literature 3).

Deficiency in regulatory T cells causes serious autoimmune diseases (see Non Patent Literature 10=Sakaguchi et al., Immunol. Rev. 182, 18-32, 2001), suggesting that autoimmunity and cancer immunity have a common mechanism (see Non Patent Literature 11=Turk et al., Immunol. Rev. 188, 122-135, 2002). As mentioned above, regulatory T cells are known to participate not only in the immunosuppression of cancer cells but in exaggerated immune response such as autoimmunity or allergic reaction, through the suppression of immune response (see Non Patent Literature 12=Miyara and Sakaguchi Trends Mol. Med. 13, 108-116, 2007).

Against this backdrop, drugs for mitigation of immunosuppression currently under development are designed to remove some immunosuppressive cell populations, such as regulatory T cells or regulatory dendritic cells, or to inhibit their functions.

Therefore, under the present circumstance, these drugs must be used in combination for modifying the whole immune system and are reportedly not much effective in actuality.

CITATION LIST

Patent Literature

[Patent Literature 1] International Publication No. WO2009/028411

Non Patent Literature

[Non Patent Literature 1] Cancer Research 73 (20); 6185-93, 2013
[Non Patent Literature 2] OncoImmunology 2: 11, e26528, 2013
[Non Patent Literature 3] Andaloussi and Lesniak Neuro-Oncology 8, 234-243, 2006
[Non Patent Literature 4] Ichihara et al. Clin. Cancer Res. 9, 4404-4408, 2003
[Non Patent Literature 5] Wolf et al. Clin. Cancer Res. 9, 606-612, 2003
[Non Patent Literature 6] Hicky et al. Semin. Immunol. 11, 125-137, 1999
[Non Patent Literature 7] Liyanage et al. J. Immunol. 169, 2756-2761, 2002
[Non Patent Literature 8] Sasada et al. Cancer 98, 1098-1099, 2003
[Non Patent Literature 9] Woo et al. Cancer Res. 61, 4766-4772, 2001
[Non Patent Literature 10] Sakaguchi et al. Immunol. Rev. 182, 18-32, 2001
[Non Patent Literature 11] Turk et al. Immunol. Rev. 188, 122-135, 2002
[Non Patent Literature 12] Miyara and Sakaguchi Trends Mol. Med. 13, 108-116, 2007

SUMMARY OF INVENTION

Solution to Problem

The present inventors have conducted diligent studies and consequently completed the present invention by finding out that: FSTL1 is a more promising target for the mitigation of immunosuppression; and the inhibition of the activity of FSTL1 is effective against the induction or growth of cancer-associated mesenchymal stem cells (MSCs) inducing immunosuppression considered to be partly responsible for the aggravation of cancer, and further against the acquirement of metastatic properties, particularly, bone metastatic properties, by cancer cells, and is remarkably effective for eliminating cancer. In the present invention, it has been found that FSTL1 can induce MSCs inducing immunosuppressive cells such as regulatory T cells, regulatory dendritic cells, tolerogenic dendritic cells, or myeloid-derived suppressor cells. Hence, it has been found that: upstream inhibition thereof may mitigate the whole mechanism of immunosuppression; and such an inhibitor is available as an effective anticancer agent. Thus, the present invention should receive attention, particularly, from the viewpoint that it is expected that cancer can be eliminated from living bodies more effectively than conventional methods by both "inhibition of MSCs inducing immune defect such as immunosuppression or immunodeficiency" and "inhibition of the metastatic properties of cancer cells". On the basis of these findings, the present inventors have further continued development and completed the present invention by further finding that the combination of an anti-FSTL1 antibody and an anti-PD-L1 antibody has unexpectedly remarkable therapeutic effects.

Thus, the present invention provides the following:

(1) A combination product of an anti-FSTL1 antibody or a fragment or functional equivalent thereof and an anti-PD-L1 antibody or a fragment or functional equivalent thereof.

(2) The combination product according to item 1, wherein the anti-FSTL1 antibody recognizes an epitope in a region selected from the group consisting of amino acid positions 148 to 170, 193 to 228, and 233 to 289 of SEQ ID NO: 250 (amino acid sequence of human FSTL1).

(3) The combination product according to item 1, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #13 (light chain: SEQ ID NO: 307; heavy chain: SEQ ID NO: 309) and #33 (light chain: SEQ ID NO: 315; heavy chain: SEQ ID NO: 317).

(4) The combination product according to any one of items 1 to 3, wherein the anti-FSTL1 antibody comprises the full-length variable regions of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #13 (light chain: SEQ ID NO: 307; heavy chain: SEQ ID NO: 309) and #33 (light chain: SEQ ID NO: 315; heavy chain: SEQ ID NO: 317).

(5) The combination product according to any one of items 1 to 4, wherein the anti-FSTL1 antibody comprises a full-length antibody selected from the group consisting of antibody #6-55 (light chain: SEQ ID NO: 365; heavy chain: SEQ ID NO: 367), #7-34 (light chain: SEQ ID NO: 369; heavy chain: SEQ ID NO: 371), #8-1 (light chain: SEQ ID NO: 373; heavy chain: SEQ ID NO: 375), #7 (light chain: SEQ ID NO: 389; heavy chain: SEQ ID NO: 391), #13 (light chain: SEQ ID NO: 397; heavy chain: SEQ ID NO: 399) and #33 (light chain: SEQ ID NO: 405; heavy chain: SEQ ID NO: 407) or a humanized sequence thereof.

(6) The combination product according to any one of items 1 to 5, wherein the anti-PD-L1 antibody has the ability to inhibit the binding between PD-L1 and PD-1.

(7) The combination product according to any one of items 1 to 6, wherein the anti-PD-L1 antibody comprises the heavy chain CDR1, heavy chain CDR2, heavy chain CDR3, light chain CDR1, light chain CDR2, and light chain CDR3 of antibody clone 10F.9G2.

(8) The combination product according to any one of items 1 to 7, wherein the anti-PD-L1 antibody comprises the full-length variable regions of antibody clone 10F.9G2.

(9) The combination product according to any one of items 1 to 8, wherein the anti-PD-L1 antibody comprises full-length antibody clone 10F.9G2 or a humanized sequence thereof.

(10) A medicament comprising a combination product according to any one of items 1 to 9.

(11) An anticancer agent comprising a combination product according to any one of items 1 to 9.

(12) A therapeutic agent for metastatic malignant tumor comprising a combination product according to any one of items 1 to 9.

(13) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising a combination product according to any one of items 1 to 9.

(14) An inhibitor of metastasis of cancer cells, comprising a combination product according to any one of items 1 to 9.

(15) The inhibitor according to item 14, wherein the metastasis includes bone metastasis or lung metastasis.

(16) An inhibitor of enhancement of immune defect by mesenchymal stem cells (MSCs), comprising a combination product according to any one of items 1 to 9.

(17) The inhibitor according to item 16, wherein the immune defect includes immunosuppression and immunodeficiency.

(18) The inhibitor according to item 16, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(19) An inhibitor of acquirement and/or enhancement of immune defect activity by or of immune-related cells, comprising a combination product according to any one of items 1 to 9.

(20) The inhibitor according to item 19, wherein the immune defect includes immunosuppression and immunodeficiency.

(21) The inhibitor according to item 16, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(22) An anticancer agent comprising an anti-FSTL1 antibody or a fragment or functional equivalent thereof, wherein the anti-FSTL1 antibody or the fragment or functional equivalent thereof is administered in combination with an anti-PD-L1 antibody or a fragment or functional equivalent thereof.

(22A) The anticancer agent according to item 22, wherein the anticancer agent has one or more features described in any one of items 1 to 21.

(23) An anticancer agent comprising an anti-PD-L1 antibody or a fragment or functional equivalent thereof, wherein the anti-PD-L1 antibody or the fragment or functional equivalent thereof is administered in combination with an anti-FSTL1 antibody or a fragment or functional equivalent thereof.

(23A) The anticancer agent according to item 23, wherein the anticancer agent has one or more features described in any one of items 1 to 21.

The present invention also provides the following:

(A1) A combination product of a FSTL1 suppressor and a PD-L1 suppressor.

(A2) The combination product according to item A1, wherein the FSTL1 suppressor and the PD-L1 suppressor are each independently selected from the group consisting of an antibody, an antigen binding fragment thereof, a derivative of the antibody or the fragment, a functional equivalent, an antisense nucleic acid, siRNA, an aptamer, and a ribozyme, and a complex thereof.

(A3) The combination product according to item A1 or A2, wherein the FSTL1 suppressor is an anti-FSTL1 antibody or a fragment or functional equivalent thereof, and the PD-L1 suppressor is an anti-PD-L1 antibody or a fragment or functional equivalent thereof.

(A4) A combination product of an anti-FSTL1 antibody or a fragment or functional equivalent thereof and an anti-PD-L1 antibody or a fragment or functional equivalent thereof.

(A5) The combination product according to item A3 or A4, wherein the anti-FSTL1 antibody recognizes an epitope in a region selected from the group consisting of amino acid positions 48 to 100, 148 to 162, 193 to 216, 205 to 228, and 272 to 289 of SEQ ID NO: 250 (amino acid sequence of human FSTL1).

(A6) The combination product according to any one of items A3 to A5, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317).

(A7) The combination product according to any one of items A3 to A6, wherein the anti-FSTL1 antibody comprises the full-length variable regions of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307;

heavy chain: SEQ ID NO: 309) and #33 (light chain: SEQ ID NO: 315; heavy chain: SEQ ID NO: 317).

(A8) The combination product according to any one of items A3 to A7, wherein the anti-FSTL1 antibody comprises a full-length antibody selected from the group consisting of antibody #6-55 (light chain: SEQ ID NO: 365; heavy chain: SEQ ID NO: 367), #7-34 (light chain: SEQ ID NO: 369; heavy chain: SEQ ID NO: 371), #8-1 (light chain: SEQ ID NO: 373; heavy chain: SEQ ID NO: 375), #7 (light chain: SEQ ID NO: 389; heavy chain: SEQ ID NO: 391), #10 (light chain: SEQ ID NO: 303; heavy chain: SEQ ID NO: 305), #13 (light chain: SEQ ID NO: 397; heavy chain: SEQ ID NO: 399) and #33 (light chain: SEQ ID NO: 405; heavy chain: SEQ ID NO: 407) or a humanized sequence thereof.

(A9) The combination product according to any one of items A3 to A8, wherein the anti-FSTL1 antibody is a humanized antibody.

(A10) The combination product according to any one of items A3 to A9, wherein the anti-FSTL1 antibody is a humanized antibody having the H chain FR1, FR2, FR3, and FR4 (SEQ ID NOs: 418, 420, 422, and 424, respectively) and L chain FR1, FR2, FR3, and FR4 (SEQ ID NOs: 434, 436, 438, and 440, respectively) of H(2)-L(1).

(A11) The combination product according to any one of items A3 to A10, wherein the anti-PD-L1 antibody has the ability to inhibit the binding between PD-L1 and PD-1.

(A12) The combination product according to any one of items A3 to A11, wherein the anti-PD-L1 antibody comprises the heavy chain CDR1, heavy chain CDR2, heavy chain CDR3, light chain CDR1, light chain CDR2, and light chain CDR3 of antibody clone MIH5 or clone 10F.9G2.

(A13) The combination product according to any one of items A3 to A12, wherein the anti-PD-L1 antibody comprises the full-length variable regions of antibody clone MIH5 or clone 10F.9G2.

(A14) The combination product according to any one of items A3 to A13, wherein the anti-PD-L1 antibody comprises full-length antibody clone MIH5 or clone 10F.9G2 or a humanized sequence thereof.

(A15) A medicament comprising a combination product according to any one of items A1 to A14.

(A16) An anticancer agent comprising a combination product according to any one of items A1 to A14.

(A17) A therapeutic agent for metastatic malignant tumor comprising a combination product according to any one of items A1 to A14.

(A18) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising a combination product according to any one of items A1 to A14.

(A19) An inhibitor of metastasis of cancer cells, comprising a combination product according to any one of items A1 to A14.

(A20) The inhibitor according to item A19, wherein the metastasis includes bone metastasis or lung metastasis.

(A21) An inhibitor of enhancement of immune defect by mesenchymal stem cells (MSCs), comprising a combination product according to any one of items A1 to A14.

(A22) The inhibitor according to item A21, wherein the immune defect includes immunosuppression and immunodeficiency.

(A23) The inhibitor according to item A21 or A22, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(A24) An inhibitor of acquirement and/or enhancement of immune defect activity by or of immune-related cells, comprising a combination product according to any one of items A1 to A14.

(A25) The inhibitor according to item A24, wherein the immune defect includes immunosuppression and immunodeficiency.

(A26) The inhibitor according to item A24 or A25, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(A27) An anticancer agent comprising a FSTL1 suppressor, wherein the FSTL1 suppressor is administered in combination with a PD-L1 suppressor.

(A28) An anticancer agent comprising an anti-FSTL1 antibody or a fragment or functional equivalent thereof, wherein the anti-FSTL1 antibody or the fragment or functional equivalent thereof is administered in combination with an anti-PD-L1 antibody or a fragment or functional equivalent thereof.

(A29) An anticancer agent comprising a PD-L1 suppressor, wherein the PD-L1 suppressor is administered in combination with a FSTL suppressor.

(A30) An anticancer agent comprising an anti-PD-L1 antibody or a fragment or functional equivalent thereof, wherein the anti-PD-L1 antibody or the fragment or functional equivalent thereof is administered in combination with an anti-FSTL1 antibody or a fragment or functional equivalent thereof.

In the present invention, one or more features mentioned above are intended to be combined as stated herein and be combinable in other ways. Those skilled in the art recognize further embodiments and advantages of the present invention by reading and understanding the detailed description given below, according to the need.

Advantageous Effects of Invention

The present invention effectively suppresses the metastasis of cancer cells directly by acting on the cancer cells through the inhibition of FSTL1 or indirectly by suppressing the differentiation induction and growth of immunosuppressive or immunodeficient cells such as regulatory T cells (Tregs) or myeloid-derived suppressor cells (MDSCs) which suppress immunity, and/or the growth and differentiation induction of mesenchymal stem cells (MSCs) which promote the enhancement of immunosuppressive activity or immunodeficient activity. Furthermore, the present invention effectively suppresses even cancer metastasis considered to be difficult to suppress, particularly, bone metastasis for which an effective treatment method has not yet been established. Moreover, the present invention suppresses differentiation induction of Tregs, tumor growth, metastasis, weight loss caused by emaciation, etc., not only in bone metastasis models but in various animal cancer models. Accordingly, the present invention provides a therapeutic drug for cancer effective over multiple aspects. Also, the present invention can mitigate the whole mechanism of immunosuppression or immunodeficiency as compared with conventional ones and therefore provides even an agent for mitigation of immunosuppression or mitigation of immunodeficiency for extensive use. The agent for mitigation of immunosuppression or mitigation of immunodeficiency of the present invention is not an agent that removes some immunosuppressive cell populations such as regulatory T cells or regulatory dendritic cells or inhibits their functions, and therefore circumvents broad conventional limitations to agents for mitigation of immunosuppression. Thus, the agent of the present invention is also effective against exhausted T cells. Hence, the agent of the present invention also has an immunodeficiency-mitigating effect and is also useful as an agent for mitigation of immune defect. In the present invention, it has been found as to these effects brought about by the inhibition of FSTL1 that more remarkable effects are exerted by combining the inhibition of FSTL1 and the inhibition of PD-L1. More specifically, unexpectedly, the inhibition of FSTL1 and the inhibition of PD-L1 exhibited synergistic effects and enhanced an antitumor effect to be equal to or greater than the synergistic effects so that subcutaneous tumor disappeared in two out of five animals.

DESCRIPTION OF EMBODIMENTS

Hereinafter, the embodiments of the present invention will be described in detail. Description about the same or similar contents will be appropriately omitted in order to avoid cumbersome repetition. It should be understood that the singular form of a word conceptually includes the plural form of the word throughout the present specification unless otherwise specified. Thus, it should be understood that the article of a singular noun (e.g., "a", "an", and "the") conceptually includes even the plural noun thereof unless otherwise specified. It should be understood that terms used herein have meanings usually used in the art unless otherwise specified. Thus, all technical terms and scientific terms used herein have the same meanings as those generally understood by those skilled in the art to which the present invention belongs, unless otherwise defined. If there is any contradiction, the present specification (including definitions) takes a priority.

First, the terms and general techniques used in the present invention will be described.

In the present specification, "FSTL1" gene encodes a protein with similarity to follistatin, an activin binding protein. FSTL1 contains an FS module contained in a follistatin-like sequence and reportedly has 10 conserved cysteine residues. Although the protein is thought to be an autoantigen associated with rheumatoid arthritis, recent findings are described in Patent Literature 1 (WO2009/028411). The accession numbers of FSTL1 described in NCBI are, for example, NP_009016 (NP_009016.1); NP_032073.2 (amino acid), and NM_007085 (NM_007085.4); NM_008047.5 (mRNA). The amino acid sequence of FSTL1 is represented by, for example, SEQ ID NO: 250 or SEQ ID NO: 252. The nucleotide sequence of FSTL1 mRNA is represented by, for example, SEQ ID NO: 251 or SEQ ID NO: 253. FSTL1 is not limited by its amino acid sequence as long as the protein has FSTL1 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

Thus, the typical nucleotide sequence of FSTL1 can be
(a) a polynucleotide having the nucleotide sequence represented by SEQ ID NO: 250 or SEQ ID NO: 252 or a fragment sequence thereof;
(b) a polynucleotide encoding a polypeptide consisting of the amino acid sequence represented by SEQ ID NO: 251 or SEQ ID NO: 253 or a fragment thereof;
(c) a polynucleotide encoding an altered polypeptide having one mutation selected from the group consisting of substitution, addition, and deletion of one or more amino acids in the amino acid sequence represented by SEQ ID NO: 251 or SEQ ID NO: 253, or a fragment thereof, the altered polypeptide having biological activity;
(d) a polynucleotide which is a splicing variant or allelic variant of the nucleotide sequence represented by SEQ ID NO: 250 or SEQ ID NO: 252, or a fragment thereof;
(e) a polynucleotide encoding a homolog of a polypeptide consisting of the amino acid sequence represented by SEQ ID NO: 251 or SEQ ID NO: 253, or a fragment thereof;
(f) a polynucleotide that hybridizes under stringent conditions to any one of the polynucleotides (a) to (e) and encodes a polypeptide having biological activity; or
(g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.

In this context, the biological activity typically refers to activity possessed by FSTL1 or means that a marker can be differentiated from other proteins present in the same organism.

The amino acid sequence of FSTL1 can be
(a) a polypeptide consisting of the amino acid sequence represented by SEQ ID NO: 251 or SEQ ID NO: 253 or a fragment thereof;
(b) a polypeptide that has one mutation selected from the group consisting of substitution, addition, and deletion of one or more amino acids in the amino acid sequence represented by SEQ ID NO: 251 or SEQ ID NO: 253, and has biological activity;
(c) a polypeptide encoded by a splicing variant or allelic variant of the nucleotide sequence represented by SEQ ID NO: 250 or SEQ ID NO: 252;
(d) a polypeptide which is a homolog of the amino acid sequence represented by SEQ ID NO: 251 or SEQ ID NO: 253; or
(e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.

In this context, the biological activity typically refers to activity possessed by FSTL1 or means that a marker can be differentiated from other proteins present in the same organism (e.g., an antigen used contains a region capable of functioning as a specific epitope). SEQ ID NOs: 250 to 253 each encode or represent a precursor containing a leader sequence. The first 20 amino acids (methionine to alanine) in SEQ ID NO: 251 and the first 18 amino acids (methionine to glycine) in SEQ ID NO: 253 are leader sequences. Thus, in the present invention, the amino acid sequence of the term FSTL1 may refer to a sequence after deletion of the leader sequence.

In relation to the present invention, "substance binding to FSTL1", "FSTL1 binding agent", or "FSTL1 interacting molecule" is a molecule or a substance binding to FSTL1 at least transiently. Preferably, it is advantageous for detection to be able to display binding (e.g., to be labeled or be a labelable state), and it is advantageous for treatment to be further bound with an agent for treatment. Examples of the substance binding to FSTL1 can include antibodies, antisense oligonucleotides, siRNA, low-molecular-weight molecules (LMW), binding peptides, aptamers, ribozymes, and peptidomimetics. The substance binding to FSTL1 or the "FSTL1 interacting molecule may be an inhibitor of FSTL1 and also includes, for example, a binding protein or a binding peptide directed to FSTL1, particularly, directed to an active site of FSTL1, and a nucleic acid directed to the FSTL1 gene. The nucleic acid against FSTL1 refers to, for example, double-stranded or single-stranded DNA or RNA inhibiting the expression of the FSTL1 gene or the activity of FSTL1, or a modified form or derivative thereof, and further includes, but is not limited to, an antisense nucleic acid, an aptamer, siRNA (small interfering RNA), and a ribozyme. In the present specification, "binding protein" or "binding peptide" as to FSTL1 refers to an arbitrary protein or peptide binding to FSTL1 and further includes, but is not limited to, an antibody (e.g., a polyclonal antibody or a monoclonal antibody), an antibody fragment, and a functional equivalent directed to FSTL1.

In the present specification, "PDL1" or "PD-L1" is a 40 kDa type 1 transmembrane protein and is also called and used interchangeably with CD274 or B7-H1. The protein has this name because of also acting as a ligand of PD-1. The accession numbers of PD-L1 described in NCBI are, for example, NP_001254635 (amino acid) for humans; NP_068693 (amino acid) for mice, and NM_001267706 (mRNA) for humans; NM_021893 (mRNA) for mice. The amino acid sequence of PD-L1 is represented by, for example, SEQ ID NO: 250 or SEQ ID NO: 252. The nucleotide sequence of PD-L1 mRNA is represented by, for example, SEQ ID NO: 251 or SEQ ID NO: 253. PD-L1 is not limited by its amino acid sequence as long as the protein has PD-L1 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

Thus, the typical nucleotide sequence of PD-L1 can be (a) a polynucleotide having the nucleotide sequence represented by SEQ ID NO: 250 or SEQ ID NO: 252 or a fragment sequence thereof;

(b) a polynucleotide encoding a polypeptide consisting of the amino acid sequence represented by SEQ ID NO: 251 or SEQ ID NO: 233 or a fragment thereof;

(c) a polynucleotide encoding an altered polypeptide having one mutation selected from the group consisting of substitution, addition, and deletion of one or more amino acids in the amino acid sequence represented by SEQ ID NO: 251 or SEQ ID NO: 233, or a fragment thereof, the altered polypeptide having biological activity;

(d) a polynucleotide which is a splicing variant or allelic variant of the nucleotide sequence represented by SEQ ID NO: 250 or SEQ ID NO: 252, or a fragment thereof;

(e) a polynucleotide encoding a homolog of a polypeptide consisting of the amino acid sequence represented by SEQ ID NO: 251 or SEQ ID NO: 253, or a fragment thereof;

(f) a polynucleotide that hybridizes under stringent conditions to any one of the polynucleotides (a) to (e) and encodes a polypeptide having biological activity; or (g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.

In this context, the biological activity typically refers to activity possessed by PD-L1 or means that a marker can be differentiated from other proteins present in the same organism.

The amino acid sequence of PD-L1 can be (a) a polypeptide consisting of the amino acid sequence represented by SEQ ID NO: 251 or SEQ ID NO: 253 or a fragment thereof;

(b) a polypeptide that has one mutation selected from the group consisting of substitution, addition, and deletion of one or more amino acids in the amino acid sequence represented by SEQ ID NO: 251 or SEQ ID NO: 253, and has biological activity;

(c) a polypeptide encoded by a splicing variant or allelic variant of the nucleotide sequence represented by
SEQ ID NO: 250 or SEQ ID NO: 252;

(d) a polypeptide which is a homolog of the amino acid sequence represented by SEQ ID NO: 251 or SEQ ID NO: 253; or (e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.

In this context, the biological activity typically refers to activity possessed by PD-L1 or means that a marker can be differentiated from other proteins present in the same organism (e.g., an antigen used contains a region capable of functioning as a specific epitope). SEQ ID NOs: 250 to 253 each encode or represent a precursor containing a leader sequence. The first 18 amino acids (methionine to alanine) in both SEQ ID NOs: 251 and 253 are leader sequences. Thus, in the present invention, the amino acid sequence of the term PD-L1 may refer to a sequence after deletion of the leader sequence.

In relation to the present invention, "substance binding to PD-L1", "PD-L1 binding agent", or "PD-L1 interacting molecule" is a molecule or a substance binding to PD-L1 at least transiently. Preferably, it is advantageous for detection to be able to display binding (e.g., to be labeled or be a labelable state), and it is advantageous for treatment to be further bound with an agent for treatment. Examples of the substance binding to PD-L1 can include antibodies, antisense oligonucleotides, siRNA, low-molecular-weight molecules (LMW), binding peptides, aptamers, ribozymes, and peptidomimetics. The substance binding to PD-L1 or the "PD-L1 interacting molecule may be an inhibitor of PD-L1 and also includes, for example, a binding protein or a binding peptide directed to PD-L1, particularly, directed to an active site of PD-L1, and a nucleic acid directed to the PD-L1 gene. The nucleic acid against PD-L1 refers to, for example, double-stranded or single-stranded DNA or RNA inhibiting the expression of the PD-L1 gene or the activity of PD-L1, or a modified form or derivative thereof, and further includes, but is not limited to, an antisense nucleic acid, an aptamer, siRNA (small interfering RNA), and a ribozyme. In the present specification, "binding protein" or "binding peptide" as to PD-L1 refers to an arbitrary protein or peptide binding to PD-L1 and further includes, but is not limited to, an antibody (e.g., a polyclonal antibody or a monoclonal antibody), an antibody fragment, and a functional equivalent directed to PD-L1.

"Derivative", "analog", or "mutant" (or "variant") used herein preferably includes a molecule containing a region substantially homologous to the protein of interest (e.g., FSTL1 or PD-L1), though any limitation is not intended. In various embodiments, such a molecule is identical by at least 30%, 40%, 50%, 60%, 70%, 80%, 90%, 95%, or 99% over amino acid sequences of the same sizes or when compared with a sequence aligned by alignment using a computer homology program known in the art, or a nucleic acid encoding such a molecule is capable of hybridizing to a sequence encoding the constituent protein, under (highly) stringent conditions, moderately stringent conditions, or non-stringent conditions. This is a product altered from a naturally occurring protein by amino acid substitution, deletion, and/or addition, and means that the protein derivative still exhibits the biological functions of the naturally occurring protein to the same extent or not to the same extent. The biological functions of such a protein may be examined by, for example, appropriate and available in vitro assay described herein or known in the art. The phrase "functionally active" used herein means that a polypeptide, i.e., a fragment or a derivative, has the structural functions, controlling functions, or biochemical functions of the protein, such as biological activity, according to an aspect related to the polypeptide, i.e., fragment or derivative, of the present invention in the present specification. In the present invention, humans are mainly discussed about FSTL1 or PD-L1. However, many non-human animals are known to express FSTL1 or PD-L1. Therefore, it is understood that these animals, particularly, mammals, are also included in the scope of the present invention.

In the present specification, "protein", "polypeptide", "oligopeptide", and "peptide" are used herein interchangeably with each other and refer to an amino acid polymer having an arbitrary length. This polymer may be linear or branched or may be cyclic. The amino acid may be natural or non-natural or may be an altered amino acid. This term may also encompass an assembly of a plurality of polypeptide chains as a complex. This term also encompasses a naturally or artificially altered amino acid polymer. Such alteration encompasses, for example, disulfide bond formation, glycosylation, lipidation, acetylation, phosphorylation, or any other operation or alteration (e.g., conjugation with a labeling component). This definition also encompasses, for example, a polypeptide containing analogs of one or two or more amino acids (including e.g., a non-natural amino acid), a peptide-like compound (e.g., a peptoid), and other alterations known in the art. In the present specification, "amino acid" is a generic name for organic compounds having amino and carboxyl groups. When the antibody according to the embodiments of the present invention comprises "particular amino acid sequence", any amino acid in the amino acid sequence may receive chemical modification. Also, any amino acid in the amino acid sequence may form a salt or a solvate. Also, any amino acid in the amino acid sequence may be in a L- or D-form. In such cases, the protein according to the embodiments of the present invention is also interpreted to comprise the "particular amino acid sequence" described above. For example, N-terminal modification (e.g., acetylation and myristoylation), C-terminal modification (e.g., amidation and glycosylphosphatidylinositol addition), or side chain modification (e.g., phosphorylation and glycosylation) is known as the in vivo chemical modification of amino acids contained in proteins. The modification may be natural or non-natural as long as the object of the present invention is met.

In the present specification, "polynucleotide", "oligonucleotide", and "nucleic acid" are used herein interchangeably with each other and refer to a nucleotide polymer having an arbitrary length. This term also includes "oligonucleotide derivative" or "polynucleotide derivative". "Oligonucleotide derivative" or "polynucleotide derivative" refers to an oligonucleotide or a polynucleotide that contains a nucleotide derivative or has an internucleotide bond different from a usual one, and is used interchangeably. Specific examples of such an oligonucleotide include 2'-O-methyl-ribonucleotide, an oligonucleotide derivative in which a phosphodiester bond in an oligonucleotide has been converted to a phosphorothioate bond, an oligonucleotide derivative in which a phosphodiester bond in an oligonucleotide has been converted to a N3'-P5' phosphoramidate bond, an oligonucleotide derivative in which ribose and a phosphodiester bond in an oligonucleotide have been converted to a peptide nucleic acid bond, an oligonucleotide derivative in which uracil in an oligonucleotide has been replaced with C-5 propynyluracil, an oligonucleotide derivative in which uracil in an oligonucleotide has been replaced with C-5 thiazoleuracil, an oligonucleotide derivative in which cytosine in an oligonucleotide has been replaced with C-5 propynylcytosine, an oligonucleotide derivative in which cytosine in an oligonucleotide has been replaced with phenoxazine-modified cytosine, an oligonucleotide derivative in which ribose in DNA has been replaced with 2'-O-propylribose, and an oligonucleotide derivative in which ribose in an oligonucleotide has been replaced with 2'-methoxyethoxyribose. A particular nucleic acid sequence is also intended to encompass an explicitly shown sequence as well as a conservatively altered form (e.g., a degenerate codon substitution variant) and a complementary sequence thereof, unless otherwise specified. Specifically, the degenerate codon substitution variant can be achieved by preparing a sequence in which the third position of one or more selected (or all) codons has been replaced with a mixed base and/or a deoxyinosine residue (Batzer et al., Nucleic Acid Res. 19: 5081 (1991); Ohtsuka et al., J. Biol. Chem. 260: 2605-2608 (1985); and Rossolini et al., Mol. Cell. Probes 8: 91-98 (1994)). In the present specification, "nucleic acid" is also used interchangeably with a gene, cDNA, mRNA, an oligonucleotide, and a polynucleotide. In the present specification, "nucleotide" may be natural or non-natural.

In the present specification, "gene" refers to an agent that governs genetic traits. "Gene" may refer to "polynucleotide", "oligonucleotide", and "nucleic acid".

In the present specification, "homology" of genes refers to the degree of identity between two or more gene sequences. In general, having "homology" means that the degree of identity or similarity is high. Thus, as the homology of two certain genes is higher, the identity or similarity of their sequences is higher. Whether or not two types of genes have homology can be examined by the direct comparison of their sequences or hybridization under stringent conditions for nucleic acids. In the case of directly comparing two gene sequences, these genes have homology when their DNA sequences are identical by typically at least 50%, preferably at least 70%, more preferably at least 80%, 90%, 95%, 96%, 97%, 98%, or 99% between the gene sequences. Thus, in the present specification, "homolog" or "homologous gene product" means a protein of another species, preferably a mammalian protein, which exerts the same biological functions as those of a protein constituent of a complex further described herein. Such a homolog is also referred to as "ortholog gene product". It is understood that such a homolog, a homologous gene product, an ortholog gene product, or the like can also be used as long as the object of the present invention is met.

An amino acid can be mentioned herein by a generally known three-letter code thereof or a one-letter code recommended by IUPAC-IUB Biochemical Nomenclature Commission. Likewise, a nucleotide may be mentioned by a generally recognized one-letter code. In the present specification, the comparison of similarity, identity, and homology between amino acid sequences and nucleotide sequences is calculated using a tool BLAST for sequence analysis with default parameters. Identity search can be performed using, for example, NCBI BLAST 2.2.28 (issued on Apr. 2, 2013). In the present specification, the value of identity usually refers to a value obtained by alignment under default conditions using the BLAST described above. However, in the case where a higher value is obtained by change of a parameter, the highest value is used as the value of identity. In the case where identity is evaluated for a plurality of regions, the highest value thereamong is used as the value of identity. The similarity is a numerical value calculated by including similar amino acids in addition to the identity.

In one embodiment of the present invention, the term "several" may be, for example, 10, 8, 6, 5, 4, 3, or 2 or may be equal to or less than any of these values. A polypeptide that has undergone the deletion, addition, or insertion of 1 or several amino acid residues, or the substitution of 1 or several amino acid residues by other amino acids is known to maintain its biological activity (Mark et al., Proc Natl Acad Sci USA. 1984 September; 81 (18): 5662-5666; Zoller et al., Nucleic Acids Res. 1982 Oct. 25; 10 (20): 6487-6500; and Wang et al., Science. 1984 Jun. 29; 224 (4656): 1431-1433.). An antibody that has undergone deletion, etc. can be prepared by, for example, site-directed mutagenesis, random mutagenesis, or biopanning using antibody phage libraries. For example, KOD-Plus-Mutagenesis Kit (Toyobo Co., Ltd.) can be used in the site-directed mutagenesis. The selection of an antibody having activity similar to that of wild type from mutant-type antibodies in which deletion, etc. has been introduced can be achieved by various characterization techniques such as FACS analysis or ELISA.

In one embodiment of the present invention, the phrase "90% or higher" may be, for example, 90, 95, 96, 97, 98, 99, or 100% or higher and may be within the range of any two of these values. The "homology" described above may be calculated as the percentage of the number of homologous amino acids between two or more amino acid sequences according to a method known in the art. Before the calculation of the percentage, a gap is introduced to a portion of amino acid sequences, if required, in order to align the amino acid sequences of an amino acid sequence group for comparison and maximize the percentage of identical amino acids. A method for alignment, a method for calculating the percentage, a comparison method, and a computer program associated therewith have heretofore been well known in the art (e.g., BLAST and GENETYX). In the present specification, "homology" can be represented by a value measured by NCBI BLAST, unless otherwise specified. Default setting of Blastp can be used in algorithms for comparing amino acid sequences by BLAST. The measurement results are converted to numerical values as positives or identities.

In the present specification, "polynucleotide hybridizing under stringent conditions" refers to well-known conditions conventionally used in the art. Such a polynucleotide can be obtained by use of colony hybridization, plaque hybridization, Southern blot hybridization, or the like using a polynucleotide selected from among the polynucleotides of the present invention as a probe. Specifically, the polynucleotide means a polynucleotide that can be identified by hybridization at 65° C. in the presence of 0.7 to 1.0 M NaCl using a colony- or plaque-derived DNA-immobilized filter, followed by the washing of the filter under 65° C. conditions using a 0.1 to 2×SSC (saline-sodium citrate) solution (the composition of a 1×SSC solution is 150 mM sodium chloride and 15 mM sodium citrate). "Stringent conditions" can adopt, for example, the following conditions: (1) low ion strength and high temperature are used for washing (e.g., 0.015 M sodium chloride/0.0015 M sodium citrate/0.1% sodium dodecyl sulfate at 50° C.), (2) a denaturant such as formamide is used in hybridization (e.g., 50% (v/v) formamide, 0.1% bovine serum albumin/0.1% Ficoll/0.1% polyvinylpyrrolidone/50 mM sodium phosphate buffer (pH 6.5), 750 mM sodium chloride, and 75 mM sodium citrate at 42° C.), or (3) the filter is incubated overnight at 37° C. in a solution containing 20% formamide, 5×SSC, 50 mM sodium phosphate (pH 7.6), a 5×Denhardt's solution, 10% dextran sulfate, and 20 mg/ml of denatured sheared salmon sperm DNA, and then washed with 1×SSC at approximately 37 to 50° C. The formamide concentration may be 50% or higher. The washing time may be 5, 15, 30, 60, or 120 minutes or longer. A plurality of factors such as temperature and salt concentration are possible as factors that influence the stringency of hybridization reaction. For the details, see Ausubel et al., Current Protocols in Molecular Biology, Wiley Interscience Publishers, (1995). An example of "highly stringent conditions" is 0.0015 M sodium chloride and 0.0015 M sodium citrate at 65 to 68° C., or 0.015 M sodium chloride, 0.0015 M sodium citrate, and 50% formamide at 42° C. The hybridization can be performed according to a method described in an experimental manual such as Molecular Cloning 2nd ed., Current Protocols in Molecular Biology, Supplement 1-38, or DNA Cloning 1: Core Techniques, A Practical Approach, Second Edition, Oxford University Press (1995). In this context, preferably, a sequence comprising only an A sequence or only a T sequence is excluded from a sequence hybridizing under stringent conditions. Moderately stringent conditions can be readily determined by those skilled in the art on the basis of, for example, the length of DNA, and are shown in Sambrook et al., Molecular Cloning: A Laboratory Manual, 3rd ed., Vol. 1, 7.42-7.45 Cold Spring Harbor Laboratory Press, 2001. As for a nitrocellulose filter, the moderately stringent conditions include use of hybridization conditions involving a prewashing solution of 5×SSC, 0.5% SDS, and 1.0 mM EDTA (pH 8.0), and approximately 50% formamide and 2×SSC to 6×SSC at approximately 40 to 50° C. (or any other similar hybridization solution such as a Stark's solution in approximately 50% formamide at approximately 42° C.), and washing conditions involving approximately 60° C., 0.5×SSC, and 0.1% SDS. Thus, the polypeptide used in the present invention also encompasses a polypeptide encoded by a nucleic acid molecule hybridizing under highly or moderately stringent conditions to a nucleic acid molecule encoding the polypeptide particularly described in the present invention.

In the present specification, "purified" substance or biological agent (e.g., nucleic acid or protein) refers to the substance or biological agent from which at least a portion of natural accompaniments has been removed. Thus, for the purified biological agent, the purity of the biological agent is usually higher than that in a state where the biological agent is normally present (i.e., the biological agent is concentrated). The term "purified" used herein means that preferably at least 75% by weight, more preferably at least 85% by weight, still more preferably at least 95% by weight, most preferably at least 98% by weight of a homotypic biological agent is present. The substance or biological agent used in the present invention is preferably a "purified" substance. "Isolated" substance or biological agent (e.g., nucleic acid or protein) used herein refers to the substance or biological agent from which natural accompaniments have been substantially removed. The term "isolated" used herein varies depending on the purpose and therefore, is not necessarily required to be indicated by purity. If necessary, this term means that preferably at least 75% by weight, more preferably at least 85% by weight, still more preferably at least 95% by weight, most preferably at least 98% by weight of a homotypic biological agent is present. The substance used in the present invention is preferably an "isolated" substance or biological agent.

In the present specification, "corresponding" amino acid or nucleic acid, or moiety refers to an amino acid or a nucleotide having or presumed to have action similar to that of a predetermined amino acid or nucleotide, or moiety in a reference polypeptide or polynucleotide for comparison, in a certain polypeptide molecule or polynucleotide molecule (e.g., FSTL1 or PD-L1). Particularly, this term refers to an amino acid that is located at a similar position in an active site and similarly contributes to catalytic activity, for an enzyme molecule, and refers to a corresponding moiety (e.g., a transmembrane domain) for a complex molecule. For example, for an antisense molecule, the corresponding amino acid or nucleic acid, or moiety can be a similar moiety in an ortholog corresponding to a particular moiety of the antisense molecule. The corresponding amino acid can be, for example, a particular amino acid that undergoes cysteinylation, glutathionylation, S—S bond formation, oxidation (e.g., oxidation of a methionine side chain), formylation, acetylation, phosphorylation, glycosylation, myrstylation, or the like. Alternatively, the corresponding amino acid may be an amino acid in charge of dimerization. Such "corresponding" amino acid or nucleic acid may be a region or a domain that spans a given range. Thus, in such a case, the corresponding amino acid or nucleic acid is referred herein to as "corresponding" region or domain. In the present invention, such a corresponding region or domain is useful for designing a complex molecule.

In the present specification, "corresponding" gene (e.g., polynucleotide sequence or molecule) refers to a gene (e.g., polynucleotide sequence or molecule) having or presumed to have action similar to a predetermined gene in a reference species for comparison, in a certain species. In the case where a plurality of genes having such action are present, the corresponding gene refers to a gene having evolutionarily the same origin. Thus, a gene corresponding to a certain gene can be an ortholog of the gene. Thus, human FSTL1 or PD-L1 can be found as corresponding FSTL1 or PD-L1 in other animals (particularly, mammals). Such a corresponding gene can be identified by use of a technique well known in the art. Thus, for example, a corresponding gene in a certain animal (e.g., mouse) can be found by using sequences such as SEQ ID NOs: 250 to 253 or 409 to 412 as query sequences for a reference gene (e.g., FSTL1 or PD-L1) of the corresponding gene and searching a database involving the sequences of the animal.

In the present specification, "fragment" refers to a polypeptide or a polynucleotide having a sequence length of 1 to n−1 with respect to a full-length polypeptide or polynucleotide (length: n). The length of the fragment can be appropriately changed according to the purpose. Examples of the lower limit of the length of the polypeptide include 3, 4, 5, 6, 7, 8, 9, 10, 15, 20, 25, 30, 40, and 50 or more amino acids. A length represented by an integer that is not specifically listed here (e.g., 11) may also be appropriate for the lower limit. Examples of the lower limit of the length of the polynucleotide include 5, 6, 7, 8, 9, 10, 15, 20, 25, 30, 40, 50, 75, and 100 or more nucleotides. A length represented by an integer that is not specifically listed here (e.g., 11) may also be appropriate for the lower limit. In the present specification, it is understood that in the case where a full-length molecule functions as, for example, a marker or a target molecule, such a fragment is included in the scope of the present invention as long as the fragment itself also has the functions as a marker or a target molecule.

According to the present invention, the term "activity" refers to a function of a molecule in the broadest sense in the present specification. The activity generally includes a biological function, a biochemical function, a physical function, or a chemical function of the molecule, though any limitation is not intended. The activity includes, for example, enzymatic activity, the ability to interact with other molecules, the ability to activate, promote, stabilize, inhibit, suppress, or destabilize the functions of other molecules, stability, or the ability to localize to a particular intracellular position. This term also relates to a function of a protein complex in the broadest sense, if applicable.

In the present specification, "biological function" when a certain gene or a nucleic acid molecule or polypeptide related thereto is mentioned refers to a particular function that can be possessed in vivo by the gene, the nucleic acid molecule, or the polypeptide. Examples thereof can include, but are not limited to, production of a specific antibody, enzymatic activity, and conferring of resistance. In the present invention, examples thereof can include, but are not limited to, a function by which FSTL1 or PD-L1 is involved in the inhibition of VLDL uptake, etc. In the present specification, the biological function can be exerted by "biological activity". In the present specification, "biological activity" refers to activity that can be possessed in vivo by a certain agent (e.g., polynucleotide and protein). The biological activity encompasses activity that exerts various functions (e.g., transactivating activity) and also encompasses, for example, activity of interacting with a certain molecule to activate or deactivate another molecule. In the case where two agents interact with each other, the biological activity can be the binding between these two molecules and biological change caused thereby. For example, two molecules are considered to be bound with each other when an antibody is precipitated using one of the molecules and also coprecipitated with the other molecule. Thus, the examination of such coprecipitation is one judgment approach. In the case where the certain agent is, for example, an enzyme, the biological activity encompasses its enzymatic activity. In another example, in the case where the certain agent is a ligand, the biological activity encompasses the binding of the ligand to a corresponding receptor. Such biological activity can be measured by a technique well known in the art. Thus, "activity" refers to various measurable indexes that indicate or reveal binding (either directly or indirectly) or influence response (i.e., having measurable influence that responds to any exposure or stimulation). Examples thereof include the affinity of a compound binding directly to the polypeptide or the polynucleotide of the present invention, the amount of an upstream or downstream protein after some stimuli or events, and measures of other similar functions.

In the present specification, "expression" of a gene, a polynucleotide, a polypeptide, or the like means that the gene, etc. assumes a different form by given action in vivo. Preferably, this term means that the gene, the polynucleotide, etc. assumes a polypeptide form through transcription and translation. The preparation of mRNA by transcription is also one form of expression. Thus, in the present specification, "expression product" includes such a polypeptide or a protein, or mRNA. More preferably, such a polypeptide or a protein form can be a post-translationally processed form. For example, the expression level of FSTL1 or PD-L1 can be determined by an arbitrary method. Specifically, the expression level of FSTL1 or PD-L1 can be determined by evaluating the amount of FSTL1 or PD-L1 mRNA, the amount of the FSTL1 or PD-L1 protein, and the biological activity of the FSTL1 or PD-L1 protein. Such a measurement value can be used in companion diagnostics. The amount of the FSTL1 or PD-L1 mRNA or protein can be determined by a method described in detail in another section herein or any other method known in the art.

In the present specification, "functional equivalent" refers to an arbitrary form that has an intended function equivalent to that of the original entity of interest, but differs structurally therefrom. Thus, it is understood that a functional equivalent of "FSTL1 or PD-L1", or an antibody thereagainst is not FSTL1 or PD-L1, or the antibody itself, but encompasses a mutant or altered form (e.g., an amino acid sequence altered form) of FSTL1 or PD-L1, or the antibody having biological effects possessed by FSTL1 or PD-L1, and a form that can be converted to FSTL1 or PD-L1, or the antibody itself, or a mutant or altered form of this FSTL1 or PD-L1, or the antibody at the time of acting (including e.g., a nucleic acid encoding FSTL1 or PD-L1, or the antibody itself, or a mutant or altered form of this FSTL1 or PD-L1, or the antibody, and a vector, a cell, and the like comprising the nucleic acid). In the present invention, it is understood that the functional equivalent of FSTL1 or PD-L1, or an antibody thereagainst can be used similarly to FSTL1 or PD-L1, or the antibody even if no mentioned so. The functional equivalent can be found by searching a database or the like. In the present specification, "search" refers to utilization of a certain nucleic acid nucleotide sequence electronically or in a biological or any other method to find another nucleic acid nucleotide sequence having a particular function and/or property. Examples of the electronical search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), and Needleman and Wunsch method (Needleman and Wunsch, J. Mol. Biol. 48: 443-453 (1970)). Examples of the biological search include, but are not limited to, stringent hybridization, macroarrays containing genomic DNA attached to nylon membranes or the like or microarrays containing genomic DNA attached to glass sheets (microarray assay), PCR, and in situ hybridization. In the present specification, the gene used in the present invention is intended to also include a corresponding gene identified by such electronical search or biological search.

An amino acid sequence having the insertion, substitution, or deletion of one or more amino acids, or the addition thereof to one or both of the ends can be used in the functional equivalent of the present invention. In the present specification, "amino acid sequence having the insertion, substitution, or deletion of one or more amino acids, or the addition thereof to one or both of the ends" means that the amino acid sequence has been altered by the substitution, etc. of a plurality of amino acids to an extent that can occur naturally by a well-known technical method such as site-directed mutagenesis, or by natural mutation. The altered amino acid sequence can be a sequence that has undergone the insertion, substitution, or deletion of, for example, 1 to 30, preferably 1 to 20, more preferably 1 to 9, further preferably 1 to 5, particularly preferably 1 or 2 amino acids, or the addition thereof to one or both of the ends. The altered amino acid sequence may be preferably an amino acid sequence derived from the amino acid sequence of FSTL1 or PD-L1 by the conservative substitution of one or more (preferably 1 or several or 1, 2, 3, or 4) amino acids. In this context, "conservative substitution" means that one or more amino acid residues are substituted by other amino acid residues chemically similar thereto so as not to substantially alter the functions of the protein. Examples thereof include the substitution of a certain hydrophobic residue by another hydrophobic residue, and the substitution of a certain polar residue by another polar residue having the same electric charge thereas. Functionally similar amino acids that permit such substitution are known in the art about each amino acid. Specific examples thereof include: non-polar (hydrophobic) amino acids such as alanine, valine, isoleucine, leucine, proline, tryptophan, phenylalanine, and methionine; polar (neutral) amino acids such as glycine, serine, threonine, tyrosine, glutamine, asparagine, and cysteine; positively charged (basic) amino acids such as arginine, histidine, and lysine; and negatively charged (acidic) amino acids such as aspartic acid and glutamic acid.

In the present specification, "suppressor" refers to a substance or an agent that inhibits the biological effects of the entity of interest (e.g., receptor or cells). The FSTL1 or PD-L1 suppressor of the present invention is an agent that can transiently or permanently reduce or delete the functions of the FSTL1 or PD-L1 or FSTL1- or PD-L1-expressing cells, etc. of interest. Examples of such an agent can include, but are not limited to, forms of antibodies, antigen binding fragments thereof, derivatives of the antibodies or the fragments, functional equivalents, antisenses, and nucleic acids such as RNAi agents (e.g., siRNA).

In the present specification, "agonist" refers to a substance that exhibits or enhances the biological effects of the entity of interest (e.g., receptor). Examples thereof can include natural agonists (also called ligands) as well as synthesized or altered agonists.

In the present specification, "antagonist" refers to a substance that suppresses or inhibits the exertion of the biological effects of the entity of interest (e.g., receptor). Examples thereof can include natural antagonists as well as synthesized or altered antagonists. The antagonist includes, for example, a substance that performs competitive suppression or inhibition with an agonist (or ligand) as well as a substance that performs non-competitive suppression or inhibition therewith. The antagonist can be obtained by altering the agonist. Because of suppressing or inhibiting physiological phenomena, the antagonist may be conceptually encompassed by a suppressor (inhibitor) or a suppressive (suppressing) agent. Thus, the antagonist is used herein substantially interchangeably with "suppressor".

In the present specification, "antibody" includes a polyclonal antibody, a monoclonal antibody, a multispecific antibody, a chimeric antibody, and an anti-idiotype antibody, and their fragments, for example, a Fv fragment, a Fab' fragment, F(ab')$_2$, and a Fab fragment, and any other conjugate or functional equivalent produced by recombination (e.g., a chimeric antibody, a humanized antibody, a multifunctional antibody, a bispecific or oligospecific antibody, a single-chain antibody, scFv, diabody, sc(Fv)$_2$ (single chain (Fv)$_2$), and scFv-Fc), in a broad sense. Such an antibody may be further covalently bound with or recombinantly fused with an enzyme, for example, alkaline phosphatase, horseradish peroxidase, or a galactosidase. The anti-FSTL1 antibody or the anti-PD-L1 antibody used in the present invention is not limited by its origin, type, shape, etc. as long as the antibody binds to the FSTL1 or PD-L1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 or PD-L1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "anti-FSTL1 antibody or anti-PD-L1 antibody" includes an antibody having binding activity against FSTL1 or PD-L1. A method for producing this anti-FSTL1 antibody or anti-PD-L1 antibody is not particularly limited, and the antibody may be produced, for example, by immunizing a mammal or bird with FSTL1 or PD-L1.

It is also understood that "functional equivalent" of "antibody against FSTL1 or PD-L1 (anti-FSTL1 antibody or anti-PD-L1 antibody) or fragment thereof" also encompasses, for example, in the case of an antibody, the antibody itself and its fragment itself having binding activity and, if necessary, suppressive activity against FSTL1 or PD-L1 as well as a chimeric antibody, a humanized antibody, a multifunctional antibody, a bispecific or oligospecific antibody, a single-chain antibody, scFv, diabody, sc(Fv)2 (single chain (Fv)2), scFv-Fc, and the like.

The anti-FSTL1 antibody or the anti-PD-L1 antibody according to one embodiment of the present invention is preferably an anti-FSTL1 antibody or an anti-PD-L1 antibody specifically binding to a particular epitope on FSTL1 or PD-L1, from the viewpoint that the growth of malignant tumor is particularly strongly suppressed.

The anti-FSTL1 antibody or the anti-PD-L1 antibody according to one embodiment of the present invention may be a monoclonal antibody. The monoclonal antibody can be allowed to act on FSTL1 or PD-L1 more efficiently than a polyclonal antibody. It is preferred to immunize a chicken with FSTL1 or PD-L1, from the viewpoint of efficiently producing the anti-FSTL1 or PD-L1 monoclonal antibody.

The antibody class of the anti-FSTL1 antibody or the anti-PD-L1 antibody according to one embodiment of the present invention is not particularly limited and may be, for example, IgM, IgD, IgG, IgA, IgE, or IgY.

The anti-FSTL1 antibody or the anti-PD-L1 antibody according to one embodiment of the present invention may be an antibody fragment having antigen binding activity (hereinafter, also referred to as "antigen binding fragment"). This case is effective, for example, for elevating stability or antibody production efficiency.

The anti-FSTL1 antibody or the anti-PD-L1 antibody according to one embodiment of the present invention may be a fusion protein. This fusion protein may be the anti-FSTL1 antibody or the anti-PD-L1 antibody N- or C-terminally bound with a polypeptide or an oligopeptide. In this context, the oligopeptide may be a His tag. The fusion protein may also be the anti-FSTL1 antibody or the anti-PD-L1 antibody fused with a partial sequence of a mouse, human, or chicken antibody. Such fusion proteins are also included in one form of the anti-FSTL1 antibody or the anti-PD-L1 antibody according to the present embodiment.

The anti-FSTL1 antibody or the anti-PD-L1 antibody according to one embodiment of the present invention may be an antibody obtained through, for example, the step of immunizing an organism with purified FSTL1 or PD-L1, FSTL1- or PD-L1-expressing cells, or a FSTL1- or PD-L1-containing lipid membrane. It is preferred to use FSTL1- or PD-L1-expressing cells in the immunization, from the viewpoint of enhancing therapeutic effects on FSTL1- or PD-L1-positive malignant tumor.

The anti-FSTL1 antibody or the anti-PD-L1 antibody according to one embodiment of the present invention may be an antibody having the CDR set of the antibody obtained through the step of immunizing an organism with purified FSTL1 or PD-L1, FSTL1- or PD-L1-expressing cells, or a FSTL1- or PD-L1-containing lipid membrane. It is preferred to use FSTL1- or PD-L1-expressing cells in the immunization, from the viewpoint of enhancing therapeutic effects on FSTL1- or PD-L1-positive malignant tumor. The CDR set is a set of heavy chain CDR1, CDR2, and CDR3 and light chain CDR1, CDR2, and CDR3.

In one embodiment of the present invention, "FSTL1- or PD-L1-expressing cells" may be obtained, for example, by transfecting cells with a polynucleotide encoding FSTL1 or PD-L1, followed by the expression of FSTL1 or PD-L1. In this context, the FSTL1 or the PD-L1 includes a FSTL1 or PD-L1 fragment. In one embodiment of the present invention, "FSTL1- or PD-L1-containing lipid membrane" may be obtained, for example, by mixing FSTL1 or PD-L1 with a lipid bilayer. In this context, the FSTL1 or the PD-L1 includes a FSTL1 or PD-L1 fragment. The anti-FSTL1 antibody or the anti-PD-L1 antibody according to one embodiment of the present invention is preferably an antibody obtained through the step of immunizing a chicken with the antigen, or an antibody having the CDR set of the antibody, from the viewpoint of enhancing therapeutic effects on FSTL1- or PD-L1-positive malignant tumor.

The anti-FSTL1 antibody or the anti-PD-L1 antibody according to one embodiment of the present invention may have any avidity as long as the purpose is attained. Examples thereof can include, but are not limited to, at least $1.0 \times 10^6$ or more, $2.0 \times 10^6$ or more, $5.0 \times 10^6$ or more, and $1.0 \times 10^7$ or more avidity. Usually, the $K_D$ value (kd/ka) may be $1.0 \times 10^{-7}$ or less and can be $1.0 \times 10^{-9}$ (M) or $1.0 \times 10^{-10}$ (M) or less.

The anti-FSTL1 antibody or the anti-PD-L1 antibody according to one embodiment of the present invention may have ADCC or CDC activity.

The anti-FSTL1 antibody or the anti-PD-L1 antibody according to one embodiment of the present invention may be an antibody binding to wild-type or mutant-type FSTL1 or PD-L1. The mutant type includes a form attributed to the difference in DNA sequence among individuals. The amino acid sequence of the wild-type or mutant-type FSTL1 or PD-L1 has preferably 80% or higher, more preferably 90% or higher, more preferably 95% or higher, particularly preferably 98% or higher homology to the amino acid sequence represented by SEQ ID NO: 251 or SEQ ID NO: 253.

In one embodiment of the present invention, "antibody" includes a molecule that can specifically bind to a particular epitope on an antigen, or a population thereof. Also, the antibody may be a polyclonal antibody or a monoclonal antibody. The antibody can be present in various forms and may be in one or more forms selected from the group consisting of, for example, a full-length antibody (antibody having Fab and Fc regions), a Fv antibody, a Fab antibody, a F(ab')$_2$ antibody, a Fab' antibody, diabody, a single-chain antibody (e.g., scFv), dsFv, a multispecific antibody (e.g., a bispecific antibody), a peptide or polypeptide having antigen binding activity, a chimeric antibody (e.g., a mouse-human chimeric antibody and a chicken-human chimeric antibody), a mouse antibody, a chicken antibody, a humanized antibody, a human antibody, and their equivalents. The antibody also includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach. Such an antibody may be further covalently bound with or recombinantly fused with an enzyme, for example, alkaline phosphatase, horseradish peroxidase, or a galactosidase. The anti-FSTL1 antibody or the anti-PD-L1 antibody used in the present invention is not limited by its origin, type, shape, etc. as long as the antibody binds to the FSTL1 or PD-L1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 or PD-L1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "polyclonal antibody" can be produced, for example, by administering an immunogen comprising the intended antigen to a mammal (e.g., a rat, a mouse, a rabbit, cattle, and a monkey), bird, or the like in order to induce the production of an antigen-specific polyclonal antibody. The administration of the immunogen may be the injection of one or more immunizing agents and, if desired, an adjuvant. The adjuvant may also be used for increasing immune response and may include, for example, a Freund's adjuvant (complete or incomplete), a mineral gel (aluminum hydroxide, etc.), or a surfactant (lysolecithin, etc.). An immunization protocol is known in the art and may be carried out by an arbitrary method for inducing immune response according to a host organism to be selected (Tanpakushitsu Jikken Handobukku (Protein Experiment Handbook in English), Yodosha Co., Ltd. (2003): 86-91).

In one embodiment of the present invention, "monoclonal antibody" includes the case where individual antibodies constituting a population are antibodies each corresponding to a substantially single epitope except for antibodies having a small amount of a mutation that can occur naturally. Alternatively, the individual antibodies constituting a population may be substantially identical antibodies except for antibodies having a small amount of a mutation that can occur naturally. The monoclonal antibody is highly specific and differs from an ordinary polyclonal antibody which typically comprise different antibodies corresponding to different epitopes. In addition to the specificity, the monoclonal antibody is useful because the monoclonal antibody can be synthesized from hybridoma culture that is not contaminated with other immunoglobulins. The epithet "monoclonal" may indicate the feature of being obtained from a substantially homogeneous antibody population, but does not mean that the antibody must be produced by a certain method. For example, the monoclonal antibody may be prepared by a method similar to a hybridoma method as described in "Kohler G, Milstein C., Nature. 1975 Aug. 7; 256 (5517): 495-497". Alternatively, the monoclonal antibody may be prepared by a method similar to a recombination method as described in U.S. Pat. No. 4,816,567. Alternatively, the monoclonal antibody may be isolated from a phage antibody library by use of a method similar to a technique as described in "Clackson et al., Nature. 1991 Aug. 15; 352 (6336): 624-628" or "Marks et al., J Mol Biol. 1991 Dec. 5; 222 (3): 581-597". Alternatively, the monoclonal antibody may be prepared by a method described in "Tanpakushitsu Jikken Handobukku (Protein Experiment Handbook in English), Yodosha Co., Ltd. (2003): 92-96".

For the large-scale production of the antibody, an arbitrary approach known in the art can be used. Typical examples of the construction of a large-scale antibody production system and antibody production can include the following: CHO cells are transfected with a H chain antibody expression vector and a L chain antibody expression vector, cultured using a selection reagent G418 and Zeocin, and cloned by a limiting dilution method. After the cloning, a clone stably expressing the antibody is selected by ELISA. The selected CHO cell is used in extended culture to recover a culture supernatant containing the antibody. The antibody can be purified by protein A or protein G purification from the recovered culture supernatant.

In one embodiment of the present invention, "Fv antibody" is an antibody containing an antigen recognition site. This region comprises a dimer of one heavy chain variable domain and one light chain variable domain through non-covalent binding. In this configuration, the respective three CDRs of the variable domains can act mutually to form an antigen binding site on the surface of the VH-VL dimer.

In one embodiment of the present invention, "Fab antibody" is, for example, an antibody comprising the N-terminal half of the H chain and the whole L chain disulfide-bonded at a part of the antibody, among fragments obtained by treating an antibody comprising Fab and Fc regions with a proteolytic enzyme papain. Fab can be obtained, for example, by treating the anti-FSTL1 antibody or the anti- PD-L1 antibody according to the embodiments of the present invention comprising Fab and Fc regions with a proteolytic enzyme papain.

In one embodiment of the present invention, "F(ab')$_2$ antibody" is, for example, an antibody containing two sites each corresponding to Fab, among fragments obtained by treating an antibody comprising Fab and Fc regions with a proteolytic enzyme pepsin. F(ab')$_2$ can be obtained, for example, by treating the anti-FSTL1 antibody or the anti-PD-L1 antibody according to the embodiments of the present invention comprising Fab and Fc regions with a proteolytic enzyme pepsin. Also, F(ab')2 can be prepared, for example, by thioether-bonding or disulfide-bonding Fab' fragments described below.

In one embodiment of the present invention, "Fab' antibody" is, for example, an antibody obtained by cleaving the disulfide bond in the hinge region of F(ab')$_2$. Fab' can be obtained, for example, by treating F(ab')$_2$ with a reducing agent dithiothreitol.

In one embodiment of the present invention, "scFv antibody" is an antibody comprising VH and VL linked via an appropriate peptide linker. The scFv antibody can be produced, for example, by obtaining cDNAs encoding VH and VL of the anti-FSTL1 antibody or the anti-PD-L1 antibody according to the embodiments of the present invention, constructing a polynucleotide encoding VH-peptide linker-VL, and integrating the polynucleotide into a vector, followed by use of cells for expression.

In one embodiment of the present invention, "diabody" is an antibody having divalent antigen binding activity. The divalent antigen binding activity may be the same antigen binding activities or may be different antigen binding activities. The diabody can be produced, for example, by constructing polynucleotides encoding scFvs such that the length of the amino acid sequence of a peptide linker is 8 or less residues, and integrating the obtained polynucleotides into a vector, followed by use of cells for expression.

In one embodiment of the present invention, "dsFv" is an antibody obtained by bonding polypeptides containing cysteine residues introduced in VH and VL, via a disulfide bond between the cysteine residues. The positions to which the cysteine residues are introduced can be selected on the basis of the conformational prediction of the antibody according to a method shown by Reiter et al. (Reiter et al., Protein Eng. 1994 May; 7 (5): 697-704).

In one embodiment of the present invention, "peptide or polypeptide having antigen binding activity" is an antibody constituted to comprise the VH or VL of the antibody, or CDR1, CDR2, or CDR3 thereof. A plurality of CDR-containing peptides can be bonded directly or via an appropriate peptide linker.

A method for producing the Fv antibody, Fab antibody, F(ab')$_2$ antibody, Fab' antibody, scFv antibody, diabody, dsFv antibody, or peptide or polypeptide having antigen binding activity (hereinafter, also referred to as "Fv antibody, etc.") described above is not particularly limited. For example, DNA encoding a region in the Fv antibody, etc. for the anti-FSTL1 antibody or the anti-PD-L1 antibody according to the embodiments of the present invention is integrated into a vector for expression, and the Fv antibody, etc. can be produced using cells for expression. Alternatively, the Fv antibody, etc. may be produced by a chemical synthesis method such as Fmoc method (fluorenylmethyloxycarbonyl method) or tBOC method (t-butyloxycarbonyl method). The antigen binding fragment according to one embodiment of the present invention may be one or more of the Fv antibody, etc.

In one embodiment of the present invention, "chimeric antibody" is, for example, an antibody comprising the variable regions of an antibody of an organism species linked to the constant regions of an antibody of an organism species different therefrom, and can be constructed by a gene recombination technique. A mouse-human chimeric antibody can be prepared by a method described in, for example, "Roguska et al., Proc Natl Acad Sci USA. 1994 Feb. 1; 91 (3): 969-973". In a basic method for preparing the mouse-human chimeric antibody, for example, mouse leader sequences and variable region sequences present in cloned cDNA are linked to human antibody constant region-encoding sequences already present in an expression vector for mammalian cells. Alternatively, mouse leader sequences and variable region sequences present in cloned cDNA may be linked to human antibody constant region-encoding sequences and then ligated with an expression vector for mammalian cells. Fragments of human antibody constant regions can be arbitrary H and L chain constant regions of a human antibody. Examples thereof can include Cyl, Cy2, Cy3, and Cy4 for human H chains and C? or CK for L chains.

In one embodiment of the present invention, "humanized antibody" is, for example, an antibody that has one or more CDRs derived from a non-human species and framework regions (FRs) derived from a human immunoglobulin, and further, human immunoglobulin-derived constant regions, and binds to a desired antigen. The antibody humanization can be carried out by use of various approaches known in the art (Almagro et al., Front Biosci. 2008 Jan. 1; 13: 1619-1633). Examples thereof include CDR grafting (Ozaki et al., Blood. 1999 Jun. 1; 93 (11): 3922-3930), re-surfacing (Roguska et al., Proc Natl Acad Sci USA. 1994 Feb. 1; 91 (3): 969-973), and FR shuffle (Damschroder et al., Mol Immunol. 2007 April; 44 (11): 3049-3060. Epub 2007 Jan. 22). In order to alter (preferably, improve) antigen binding, an amino acid residue in a human FR region may be substituted by a corresponding residue from a CDR donor antibody. This FR substitution can be carried out by a method well known in the art (Riechmann et al., Nature. 1988 Mar. 24; 332 (6162): 323-327). For example, a FR residue important for antigen binding may be identified by the interaction modeling of CDR and FR residues. Alternatively, an abnormal FR residue may be identified at a particular position by sequence comparison. In a preferred embodiment, the humanized antibody may be constructed on the basis of the report of Matsuda et al. Molecular Immunology 43 (2006) 634-642.

In a preferred embodiment of the present invention, a humanized antibody having the H chain FR1, FR2, FR3, and FR4 (SEQ ID NOs: 418, 420, 422, and 424, respectively) and L chain FR1, FR2, FR3, and FR4 (SEQ ID NOs: 434, 436, 438, and 440, respectively) of H(2)-L(1) can be used, though the humanized antibody of the present invention is not limited thereto. As for the full-length sequences of the humanized antibody, the full-length sequence of the H(1) heavy chain in this humanized antibody is represented by SEQ ID NOs: 441 and 442 (which represent nucleic acid and amino acid sequences, respectively) for IgG1 type and represented by SEQ ID NOs: 447 and 448 (which represent nucleic acid and amino acid sequences, respectively) for IgG4 type. The full-length sequence of the H(2) heavy chain is represented by SEQ ID NOs: 443 and 444 (which represent nucleic acid and amino acid sequences, respectively) for IgG1 type and represented by SEQ ID NOs: 449 and 450 (which represent nucleic acid and amino acid sequences, respectively) for IgG4 type. The full-length sequence of the H(3) heavy chain is represented by SEQ ID NOs: 445 and 446 (which represent nucleic acid and amino acid sequences, respectively) for IgG1 type and represented by SEQ ID NOs: 451 and 452 (which represent nucleic acid and amino acid sequences, respectively) for IgG4 type. The full-length sequence of the L(1) light chain is represented by SEQ ID NOs: 453 and 454 (which represent nucleic acid and amino acid sequences, respectively). The full-length sequence of the L(2) light chain is represented by SEQ ID NOs: 495 and 496 (which represent nucleic acid and amino acid sequences, respectively). The full-length sequence of the L(3) light chain is represented by SEQ ID NOs: 497 and 498 (which represent nucleic acid and amino acid sequences, respectively). Although not wishing to be bound by any theory, activity higher by an order of magnitude was observed in H(2)-L(1) than H(3)-L(1) (frameworks of H(3): SEQ ID NOs: 426, 428, 430, and 432, respectively) and H(1)-L(1) (frameworks of H(1): SEQ ID NOs: 410, 412, 414, and 416, respectively).

In one embodiment of the present invention, "human antibody" is, for example, an antibody in which a region comprising heavy chain variable and constant regions and light chain variable and constant regions constituting the antibody is derived from a gene encoding a human immunoglobulin. A typical preparation method includes a transgenic mouse method for human antibody preparation, a phage display method, or the like. In the transgenic mouse method for human antibody preparation, a human antibody having diverse antigen binding ability instead of a mouse antibody is produced by transferring a functional human Ig gene to a mouse in which endogenous Ig has been knocked down. A human monoclonal antibody can be obtained by a conventional hybridoma method by further immunizing this mouse. This preparation can be performed by a method described in, for example, "Lonberg et al., Int Rev Immunol. 1995; 13 (1): 65-93". The phage display method is typically a system that allows a fibrous phage such as M13 or T7, an E. coli virus, to express a foreign gene as a fusion protein at the N terminus of its coat protein (g3p, g10p, etc.) so as not to lose the infectivity of the phage. This preparation can be performed by a method described in, for example, "Vaughan et al., Nat Biotechnol. 1996 March; 14 (3): 309-314".

The antibody may be prepared by grafting the heavy chain CDRs or light chain CDRs of the anti-FSTL1 antibody or the anti-PD-L1 antibody according to the embodiments of the present invention to an arbitrary antibody according to CDR grafting (Ozaki et al., Blood. 1999 Jun. 1; 93 (11): 3922-3930). Alternatively, the antibody can be obtained by ligating DNAs encoding the heavy chain CDRs or light chain CDRs of the anti-FSTL1 antibody or the anti-PD-L1 antibody according to the embodiments of the present invention, and DNAs encoding the regions, except for heavy chain CDRs or light chain CDRs, of a publicly known antibody derived from a human or a non-human organism with a vector according to a method known in the art, followed by expression using publicly known cells. In this respect, in order to enhance the action efficiency of the anti-FSTL1 antibody or the anti-PD-L1 antibody on the target antigen, the regions except for heavy chain CDRs or light chain CDRs may be optimized by use of a method known in the art (e.g., a method of randomly mutating amino acid residues of antibodies and screening for an antibody having high reactivity, or a phage display method). Also, FR regions may be optimized by use of, for example, FR shuffle (Damschroder et al., Mol Immunol. 2007 April; 44 (11): 3049-3060, Epub 2007 Jan. 22) or a method for substituting vernier zone amino acid residues or packaging residues (Japanese Patent Laid-Open No. 2006-241026; and Foote et al., J Mol Biol. 1992 Mar. 20; 224 (2): 487-499).

In one embodiment of the present invention, "heavy chain" is typically a main constituent of a full-length antibody. The heavy chain is usually disulfide-bonded or non-covalently bonded to a light chain. The N-terminal domain of the heavy chain has a region called variable region (VH) whose amino acid sequence is not constant even among antibodies of the same species and the same class. In general, VH is known to largely contribute to specificity and affinity for an antigen. For example, "Reiter et al., J Mol Biol. 1999 Jul. 16; 290 (3): 685-98" states that a molecule of only VH was prepared and consequently bound to an antigen specifically and with high affinity. "Wolfson W, Chem Biol. 2006 December; 13 (12): 1243-1244" states that among camel antibodies, there exist antibodies lacking light chains and having only heavy chains.

In one embodiment of the present invention, "CDRs (complementarity determining regions)" are regions that come in actual contact with an antigen and form a binding site in the antibody. In general, CDRs are positioned on Fv (comprising a heavy chain variable region variable region (VH) and a light chain variable region (VL)) of the antibody. In general, CDRs include CDR1, CDR2, and CDR3 each consisting of approximately 5 to 30 amino acid residues. Particularly, heavy chain CDRs are known to contribute to the binding of the antibody to the antigen. Among CDRs, CDR3 is known to make the highest contribution to the binding of the antibody to the antigen. For example, "Willy et al., Biochemical and Biophysical Research Communications Volume 356, Issue 1, 27 Apr. 2007, Pages 124-128" states that the binding ability of an antibody was enhanced by altering heavy chain CDR3. Fv regions other than CDRs are called framework regions (FRs) which consist of FR1, FR2, FR3, and FR4, and are relatively well conserved among antibodies (Kabat et al., "Sequence of Proteins of Immunological Interest", US Dept. Health and Human Services, 1983). In short, a factor that characterizes the reactivity of the antibody is CDRs, particularly, heavy chain CDR.

There are a plurality of reports on the definition of CDRs and methods for determining the positions thereof. For example, the definition of Kabat (Sequences of Proteins of Immunological Interest, 5th ed., Public Health Service, National Institutes of Health, Bethesda, Md. (1991)) or the definition of Chothia (Chothia et al., J. Mol. Biol., 1987; 196: 901-917) may be adopted. In one embodiment of the present invention, the definition of Kabat is adopted as a suitable example, though the definition of CDRs is not necessarily limited thereto. In some cases, CDRs may be determined in consideration of both the definition of Kabat and the definition of Chothia. For example, overlapping moieties of CDRs according to the respective definitions or moieties including both CDRs of the respective definitions may be used as CDRs. Specific examples of such a method include the method of Martin et al. using Oxford Molecular's AbM antibody modeling software (Proc. Natl. Acad. Sci. USA, 1989; 86: 9268-9272), which is a combined method of the definition of Kabat and the definition of Chothia. A mutant that may be used in the present invention can be produced using such information on CDRs. Such an antibody mutant can be produced such that the substitution, addition, or deletion of 1 or several (e.g., 2, 3, 4, 5, 6, 7, 8, 9, and 10) amino acids is contained in a framework of the original antibody whereas no mutation is contained in the CDRs.

In the present specification, "antigen" refers to an arbitrary substrate to which an antibody molecule is capable of specifically binding. In the present specification, "immunogen" refers to an antigen capable of initiating lymphocyte activation resulting in antigen-specific immune response. In the present specification, "epitope" or "antigen determinant" refers to a site in an antigen molecule to which an antibody or a lymphocyte receptor binds. A method for determining the epitope is well known in the art. Those skilled in the art can determine such an epitope by use of such a well-known technique conventionally used, provided that the primary sequence of a nucleic acid or an amino acid is provided. It is understood that an antibody having a sequence different from that of the antibody of the present invention can be similarly used as long as the epitope for the antibody is the same as that for the antibody of the present invention.

It is understood that an antibody having any specificity may be used as the antibody used herein as long as false positivity is decreased. Thus, the antibody used in the present invention may be a polyclonal antibody or may be a monoclonal antibody.

In the present specification, "means" refers to a unit that can serve as an arbitrary tool to achieve a certain purpose (e.g., detection, diagnosis, and treatment). In the present specification, particularly, "selectively recognizing means" refers to means that can recognize a certain subject distinctively from others.

"Malignant tumor" used herein includes, for example, tumor that is developed by the mutation of normal cells. The malignant tumor may be developed from every organ or tissue throughout the body. The malignant tumor is used herein interchangeably with "cancer" unless otherwise specified. This malignant tumor includes one or more selected from the group consisting of, for example, lung cancer, esophageal cancer, stomach cancer, liver cancer, pancreatic cancer, kidney cancer, adrenal cancer, bile duct cancer, breast cancer, colorectal cancer, small intestine cancer, ovary cancer, uterine cancer, bladder cancer, prostate cancer, ureter cancer, renal pelvis cancer, ureter cancer, penis cancer, testis cancer, brain tumor, cancer of the central nervous system, cancer of the peripheral nervous system, head and neck cancer, glioma, glioblastoma multiforme, skin cancer, melanoma, thyroid gland cancer, salivary gland cancer, malignant lymphoma, carcinoma, sarcoma, leukemia, and malignant blood tumor. In this context, the ovary cancer includes, for example, ovarian serous adenocarcinoma or ovarian clear cell adenocarcinoma. The uterine cancer includes, for example, endometrial cancer or uterine cervical cancer. The head and neck cancer includes, for example, mouth cancer, throat cancer, larynx cancer, nasal cavity cancer, sinus cancer, salivary gland cancer, or thyroid gland cancer. The lung cancer includes, for example, non-small cell lung cancer or small-cell lung cancer. The malignant tumor may be FSTL1- or PD-L1-positive.

In the present specification, "metastasis" refers to the process in which cancer spreads or travels from a primary focus to other regions of the body to develop a similar cancerous lesion at a new site. "Metastatic" or "metastasizing" cell is a cell that loses adhesive contact with adjacent cells and travels from a primary focus of the disease through blood flow or lymph to invade a neighboring structure of the body. In the present specification, the term "metastasis" preferably includes, but is not limited to, metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the metastasis of the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, "bone metastasis" means metastasis of cancer to bone and includes bone metastasis of an arbitrary origin. The term "bone metastasis" preferably includes, but is not limited to, bone metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the term "bone metastasis" also preferably includes a bone lesion, preferably an osteolytic and/or osteogenic bone lesion, more preferably an osteolytic bone lesion, still more preferably a bone lesion of myeloma, malignant myeloma, and/or multiple myeloma, particularly an osteolytic bone lesion of myeloma, malignant myeloma, and/or multiple myeloma. According to the present invention, the term "bone metastasis" also preferably includes a bone lesion of Waldenstrom's disease, preferably an osteolytic and/or osteogenic bone lesion of Waldenstrom's disease, more preferably an osteolytic bone lesion of Waldenstrom's disease. The bone metastasis according to the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

Mesenchymal stem cells induce or enhance immune defect such as immunosuppression or immunodeficiency. Activation is essential for acquiring this activity. MSCs increasing in number in association with cancer are considered to be "activated MSCs" after activation by various in vivo agents. In the present specification, such MSCs are also referred to as "activated mesenchymal stem cells" or "activated MSCs". Specifically, there exists the mechanism of immune defect, including, for example, the case where cells originally having immunosuppressive activity (e.g., regulatory T cells, tolerogenic dendritic cells, regulatory dendritic cells, and myeloid-derived suppressor cells) grow so that immunosuppressive activity is comprehensively strengthened, the case where cells normally having no activity (i.e., progenitor cells) acquire immunosuppressive properties to increase the rate of conversion to their cells having immunosuppressive activity (e.g., regulatory T cells, tolerogenic dendritic cells, regulatory dendritic cells, and myeloid-derived suppressor cells) so that immunosuppressive activity is strengthened, and induction of exhausted T cells that fall into an immunocompromised status that fails to exert immune functions. FSTL1 is considered to control the mechanism directly and/or indirectly via the growth of activated MSCs, etc. (Immunology and Cell Biology 91: 12-18, 2013). Although not wishing to be bound by any theory, the antibody FSTL1 antibody, etc. of the present invention can inhibit the induction or enhancement of immunosuppression by these MSCs, and immunodeficiency, etc. and can thereby mitigate immunosuppression responsible for the aggravation of cancer. Hence, remarkable prophylactic or therapeutic effects on cancer can be achieved. As for the induction or enhancement of MSCs inducing these cells for immune defect such as immunosuppressive cells and/or immunodeficient cells, it is considered that the present invention can inhibit an upstream region thereof and can therefore mitigate the whole mechanism of immune defect such as immunosuppression and/or immunodeficiency. Thus, more effective treatment is probably achieved.

Figure 39:
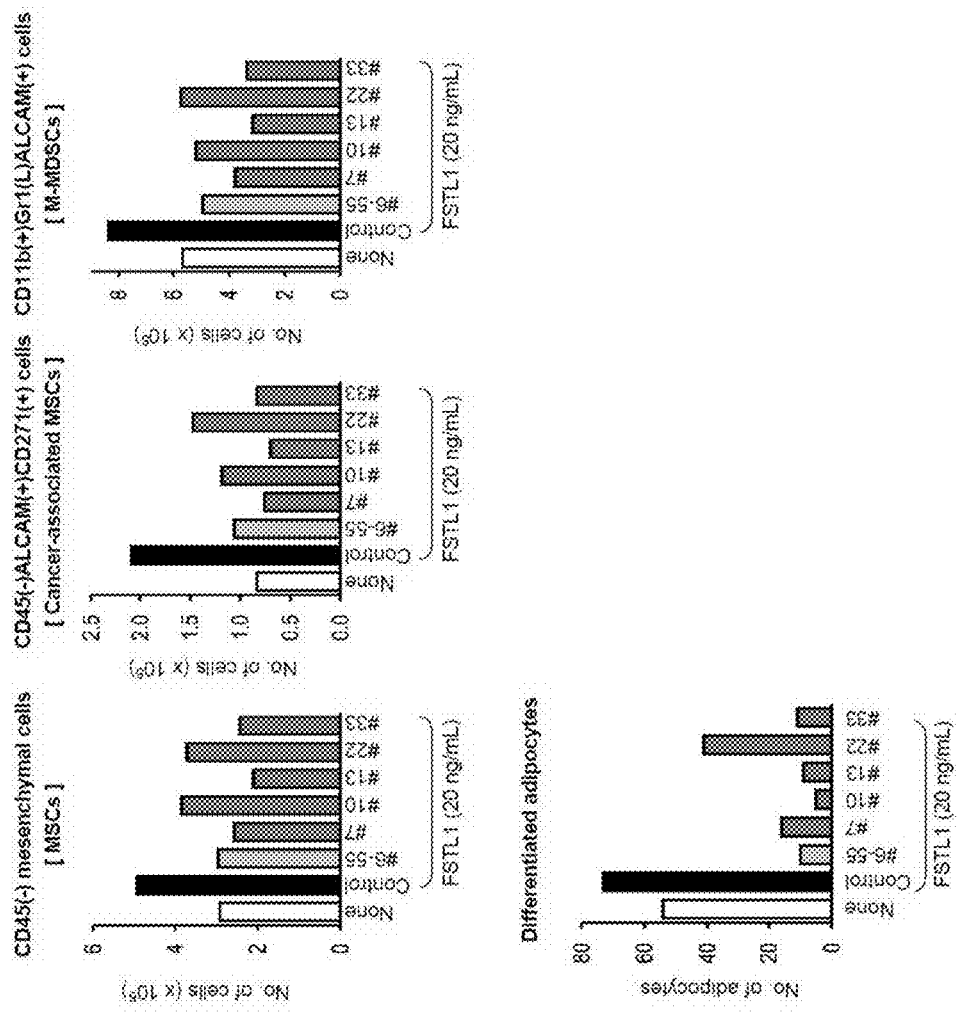
FIG. 39 Part A shows results of conducting the same test as that of FIG. 38 using other clones (clones described in each graph) (Example 14). As in FIG. 38, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody (anti-DNP antibody) is depicted shown in the second bar from the left, the anti-PD-L1 antibody is depicted in the rightmost bar, and intermediate 4 clones respectively represent the anti-FSTL1 antibodies. As a result, all of the clones exhibited inhibitory activity against the induction of MSCs, cancer-associated MSCs, and MDSCs by FSTL1, as compared with the control antibody. Among them, #13 and #33 exhibited inhibitory activity equivalent to or higher than that of the positive control (#6-55). These results seem to be reasonable because epitopes for #13 and #6-55 are the same regions. Part B shows results of analyzing inhibitory activity against the induction of MSCs having the ability to differentiate into adipocytes. In the graph, none is depicted in the leftmost bar, and a control is depicted in the second bar from the left followed by anti-FSTL1 antibody clones. All of the anti-FSTL1 antibody clones exhibited inhibitory activity against the differentiation induction of MSCs having the ability to differentiate into adipocytes by FSTL1.
Figure 40:
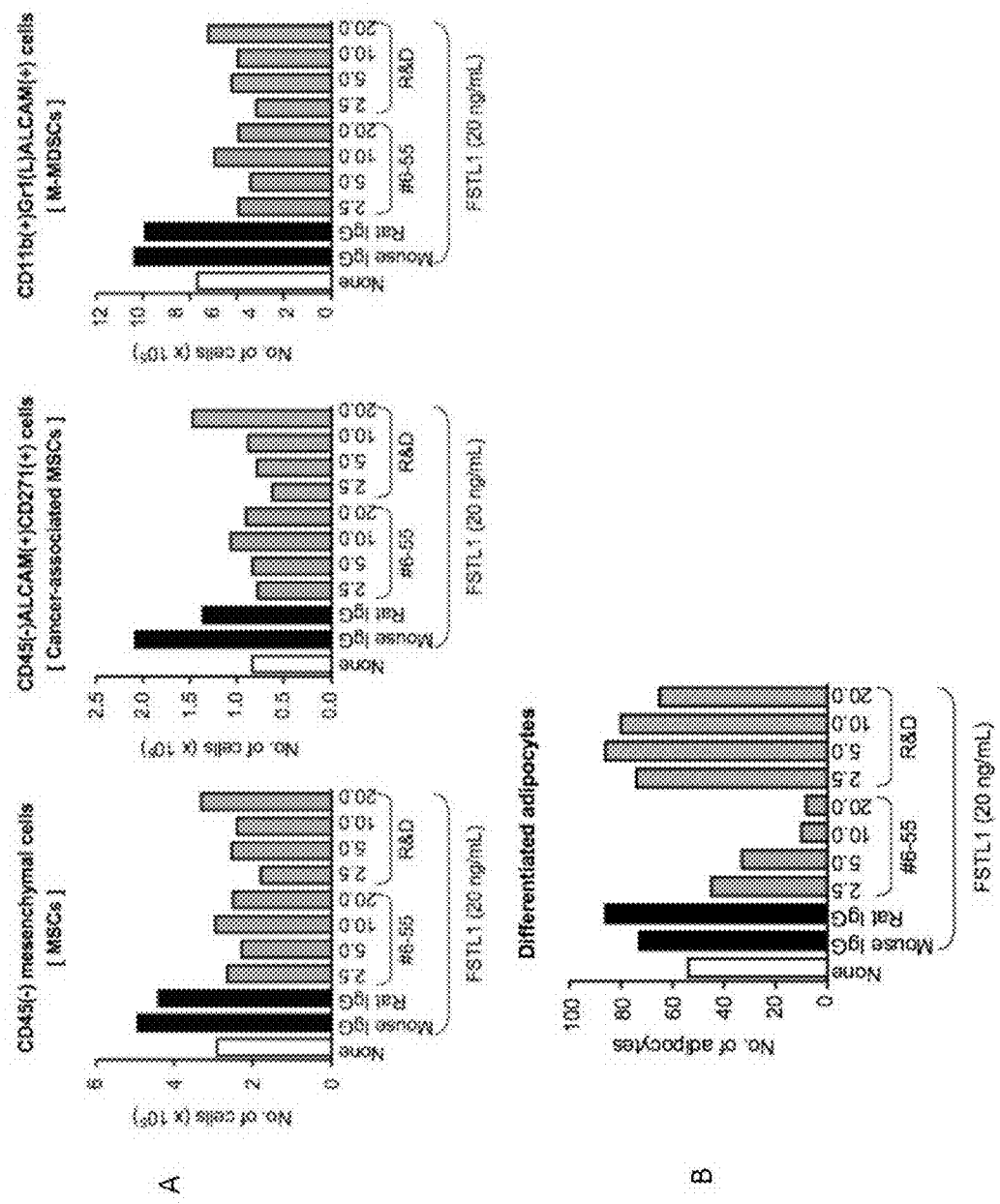
FIG. 40 shows activity comparison with an anti-FSTL1 antibody manufactured by R&D Systems, Inc. evaluated in Examples of Patent Literature 1 (WO2009/028411) (Examples 15 and 16). Part A shows results of conducting a dose dependence test in order to compare #6-55 (mouse chimeric antibody) with the anti-FSTL1 antibody manufactured by R&D Systems, Inc. (rat antibody; indicated by R&D), and analyzing inhibitory activity against the action of FSTL1 in the same way as in FIG. 38 (Example 15). In Part A, as in FIG. 38, mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The antibody manufactured by R&D Systems, Inc. exhibited inhibitory activity against the induction of each cell by FSTL1 at the same level as in #6-55. No dose-dependent effect was confirmed. When the antibody of each isotype is used as a reference, the inhibitory activity of #6-55 is considered to be slightly superior. Part B shows results of analyzing inhibitory activity against the induction of MSCs having the ability to differentiate into adipocytes (Example 16). In the graph, none is depicted in the leftmost bar, a mouse control antibody is depicted in the second bar from the left, and a rat control antibody is depicted in the third bar from the left. Two clones represent respective anti-FSTL1 antibodies, and the numerical values represent the amounts (μg/mL) of the antibodies used. The induction of MSCs having the ability to differentiate into adipocytes was inhibited by #6-55 in an antibody dose-dependent manner. On the other hand, the antibody manufactured by R&D Systems, Inc. exhibited no inhibitory activity, demonstrating the superiority of the antibody of #6-55. The ability to differentiate into adipocytes is one of the functions of cancer-associated MSCs (cells also shown in the middle graph of Part A) inducing immunosuppression. From the comparison of Part A with Part B, it can be concluded that: when the rat control antibody, i.e., a "rat-derived protein", was administered into the living bodies of mice, its own response was reduced, as compared with the case of administering the mouse control antibody (mouse-derived protein) (particularly, the middle graph of Part A). This is presumably because immune response to foreign matter occurred slightly because mouse bone marrow cells were used. In the case of administering the FSTL1 antibody of R&D Systems, Inc., which is also a "rat-derived protein", comparison with this rat control antibody administration group was supposed to be reasonable. Nonetheless, in light of the "rate of suppression" with respect to each control protein, the rate of suppression of the FSTL1 antibody of R&D Systems, Inc. with respect to the rat control antibody administration group was smaller than the rate of suppression of 6-55 with respect to the mouse control antibody administration group, suggesting that #6-55 is superior as a matter of fact. Not all of CD45-negative MSCs induced by FSTL1 are cancer-associated MSCs which cause immunosuppression, and such cancer-associated MSCs need to be identified using several types of markers, the ability to differentiate into adipocytes, etc. It can be concluded that the antibody of the present invention can strongly inhibit the induction of cancer-associated MSCs by inhibiting the action of FSTL1.

The suppression of induction or growth of mesenchymal stem cells (MSCs) (including cancer-associated MSCs and activated MSCs) can be confirmed, for example, by examining the inhibition of differentiation of MSCs into adipocytes, for example, as shown in FIGS. 39 and 40. Although not wishing to be bound by any theory, FSTL1 is considered to increase the number of immunosuppressive MSCs themselves and/or to strengthen suppressive activity against other cells.

In the present specification, "enhancement" of "immunosuppression" (the term "immunosuppression" is also referred to as immunosuppressive properties, immunoregulation, immunoregulatory properties, immunomodulation, immunomodulatory properties, immunomodification, and immunomodifying properties, and these terms are used interchangeably in the art) conceptually encompasses enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells) and refers to consequent enhancement of immunosuppression. Thus, it is understood that the enhancement of immunosuppression conceptually includes enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells). The manner of induction of immunosuppressive cells by MSC cells encompasses promotion of differentiation into immunosuppressive cells such as regulatory T cells, enhancement of the immunosuppressive activity of immunosuppressive cells such as regulatory T cells, and growth of immunosuppressive cells such as regulatory T cells, and encompasses consequent enhancement of immunosuppressive properties.

In the present specification, "immunosuppressive cells" (the term "immunosuppressive" is also referred to as immunoregulatory, immunomodulatory, and immunomodifying, and these terms are used interchangeably in the art) refer to cells having a function of suppressing immune competence. Typical examples thereof can include, but are not limited to, regulatory T cells, regulatory dendritic cells, tolerogenic dendritic cells, and myeloid-derived suppressor cells.

It is known that not only immunosuppression as described above but immunodeficiency plays a role in the mechanism underlying the disruption of immune functions by mesenchymal stem cells (MSCs). The immunosuppression and the immunodeficiency are collectively referred to as "immune defect".

In the present specification, "immunodeficiency" refers to a state in which the normal immune mechanism has been damaged due to a lack or dysfunction of a portion or some of cellular elements constituting the immune system. Pathological conditions caused thereby are collectively referred to as immunodeficiency diseases. The immunodeficiency diseases are broadly divided into primary and secondary diseases. The former is mainly ascribable to congenital genetic abnormality, and the latter refers to diseases caused by physicochemical factors such as drugs or X-ray or external environmental factors such as viral infection or nutritional status. The damaged site is reportedly attributed to various causes such as dysfunction of a B cell zone such as antibody production, abnormality in T cell zone involved in cellular immunity, and impaired functions of cells of the complement system or the phagocytic system (e.g., a phagocytic function). "Exhausted T cells" serve as a main index for immunodeficiency. The anti-PD-1 antibody, etc. is also developed as an antibody that can inhibit this "exhaustion/incompetence".

In the present specification, "immune defect" conceptually refers to immunosuppression and immunodeficiency in combination. When the immune defect occurs, low immunogenic cancer cells more advantageous for survival grow selectively (an equilibrium phase (state in which cancer cells neither disappear nor grow through their interaction with immunocytes) is shifted to an escape phase). It is considered that the immunogenicity of cancer is reduced in a short time from the end of the equilibrium phase through the escape phase. T cells supposed to kill cancer cells reportedly play this role paradoxically.

In the present specification, "exhaustion" means that various co-suppressive molecules such as PD-1, CTLA4, and TIM3 (mentioned later) are induced on T cells due to long-term exposure to an antigen so that the T cells fall into a dysfunctional state. This is considered to be responsible for inducing the irresponsiveness of T cells in chronic infection or cancer. In the present specification, such T cells are referred to as "exhausted T cells".

The anti-PD-1 antibody, etc. is also developed as an antibody that can inhibit this "exhausted" state and "immunodeficiency". Thus, the anti-FSTL1 antibody used in the present invention can inhibit (growth or development of) exhausted T cells as shown in Examples, and is therefore expected to be able to inhibit such "exhausted" state and "immunodeficiency". Thus, it is understood that "immune defect" can be inhibited.

In the present specification, "immune-related cells" refer to arbitrary cells of the immune system that undergo immunosuppression, dysfunction, etc. In the present specification, it is understood that "acquirement and/or enhancement of immunosuppressive activity by or of immune-related cells" typically include, for example, growth of regulatory T cells, differentiation into regulatory T cells, growth of regulatory dendritic cells, differentiation into regulatory dendritic cells, growth of tolerogenic dendritic cells, differentiation into tolerogenic dendritic cells, growth of myeloid-derived suppressor cells, differentiation into myeloid-derived suppressor cells, and expansion of exhausted T cells.

In the present specification, "test subject" refers to a subject to be diagnosed, detected, or treated, for example, according to the present invention (e.g., an organism such as a human, or cells, blood, serum, etc. separated from the organism).

In the present specification, "sample" refers to an arbitrary substance obtained from a test subject or the like and includes, for example, serum. Those skilled in the art can appropriately select a preferred sample on the basis of the description of the present specification.

In the present specification, "agent" is used in a broad sense and may be any substance or other factor (e.g., energy such as light, radioactivity, heat, or electricity) as long as the intended purpose can be attained. Examples of such a substance include, but are not limited to, proteins, polypeptides, oligopeptides, peptides, polynucleotides, oligonucleotides, nucleotides, nucleic acids (including e.g., DNA such as cDNA and genomic DNA, and RNA such as mRNA), polysaccharides, oligosaccharides, lipids, organic small molecules (e.g., hormones, ligands, signaling substances, organic small molecules, molecules synthesized by combinatorial chemistry, and pharmaceutically available small molecules (e.g., low-molecular ligands)), and complex molecules thereof. Typical examples of the agent specific for a polynucleotide include, but are not limited to, a polynucleotide having complementarity with given sequence homology (e.g., 70% or higher sequence identity) to the sequence of the polynucleotide, and a polypeptide such as a transcriptional factor binding to a promoter region. Typical examples of the agent specific for a polypeptide include, but are not limited to, an antibody specifically directed to the polypeptide, or a derivative thereof, or an analog thereof (e.g., a single-chain antibody), a specific ligand or receptor when the polypeptide is a receptor or a ligand, and a substrate when the polypeptide is an enzyme.

In the present specification, "diagnosis" means that various parameters associated with a disease, a disorder, a condition (e.g., malignant tumor), or the like in a test subject are identified to determine the current status or future of such a disease, disorder, or condition. The state within the body can be examined by use of the method, the apparatus, or the system of the present invention. Various parameters such as the disease, disorder, or condition in the test subject, a procedure to be administered, or a formulation or a method for prevention can be selected using such information. In the present specification, "diagnosis" refers to the diagnosis of the current status in a narrow sense and includes "early diagnosis", "predictive diagnostics", "pre-diagnosis", and the like in a broad sense. The diagnosis method of the present invention is industrially useful because the method can utilize materials separated from the body, as a rule, and can be carried out with no help from healthcare professionals such as physicians. In the present specification, particularly, "predictive diagnostics, pre-diagnosis, or diagnosis" is also referred to as "support" in order to clarify feasibility with no help from healthcare professionals such as physicians.

In the present specification, the term "prognosis" means prediction of the possibility of death or progression attributed to cancer, such as recurrence, metastatic spread, and drug resistance of a neoplastic disease such as malignant tumor (e.g., ovary cancer). Thus, in the present specification, "good prognosis" means that recurrent cancer originating from the primary cancer is absent beyond a given period (e.g., 4 years) after cancer tissue resection. "Poor prognosis" means that recurrent cancer originating from the primary cancer is present beyond a given period (e.g., 4 years) after cancer tissue resection. A prognosis factor is a variable regarding the natural course of malignant tumor and influences the rate of recurrence and outcome of a patient that has suffered from malignant tumor. A clinical index related to the worsening of prognosis includes, for example, lymph node metastasis and high-grade tumor. The prognosis factor is often used for classifying patients into subgroups having different basic risks of recurrence. Accordingly, the expression of the FSTL1 of the present invention can be used as a prognosis factor. In the present specification, the term "prediction" means the possibility that a patient has a particular clinical outcome, regardless of whether to be good or poor, after removal of primary tumor. Thus, the FSTL1 of the present invention can be used as a marker for poor prognosis. A treatment method can be determined by selecting a treatment method optimal for a particular patient by clinical use of the prediction method of the present invention. The prediction method of the present invention is beneficial means for prediction provided that there is the possibility that a patient has good response to a treatment regimen, for example, surgical intervention. The prediction can involve a prognosis factor.

In the present specification, "detecting drug (agent)" or "testing drug (agent)" refers to every agent that permits detection or test of a targeted subject in a broad sense.

In the present specification, "diagnostic drug (agent)" refers to every agent that permits diagnosis of a targeted condition (e.g., a disease such as malignant tumor) in a broad sense.

In the present specification, "treatment" of a certain disease or disorder (e.g., malignant tumor) refers to the prevention of aggravation of such a disease or disorder, preferably status quo, more preferably alleviation, further preferably resolution, of such a disease or disorder, after occurrence of such a condition. The treatment includes capability of exerting a symptom-ameliorating effects or prophylactic effects on a disease in a patient or one or more symptoms associated with the disease. Appropriate treatment based on pre-diagnosis is referred to as "companion treatment". A diagnostic drug therefor is also referred to as "companion diagnostic drug".

In the present specification, "therapeutic drug (agent)" refers to every agent that permits treatment of a targeted condition (e.g., a disease such as malignant tumor) in a broad sense. In one embodiment of the present invention, "therapeutic drug" may be a pharmaceutical composition comprising an active ingredient and one or more pharmacologically acceptable carriers. The pharmaceutical composition can be produced, for example, by mixing the active ingredient with the carriers and performing an arbitrary method known in the pharmaceutical technical field. The therapeutic drug is not limited by the type of usage as long as the therapeutic drug is used for treatment. The therapeutic drug may be the active ingredient alone or may be a mixture of the active ingredient and an arbitrary ingredient. The carriers are not particularly limited by their forms and may be, for example, solids or liquids (e.g., buffer solutions). The therapeutic drug for malignant tumor includes a drug for use in the prevention of malignant tumor (prophylactic drug) or a growth suppressor of malignant tumor cells.

In the present specification, "prevention" of a certain disease or disorder (e.g., malignant tumor) refers to protection against occurrence of such a condition before occurrence of this condition. Diagnosis is conducted using the agent of the present invention, and the prevention of, for example, malignant tumor, or measures for the prevention can be carried out using the agent of the present invention according to the need.

In the present specification, "prophylactic drug (agent)" refers to every agent that permits prevention of a targeted condition (e.g., a disease such as malignant tumor) in a broad sense.

In the present specification, "interaction" when two substances are mentioned means that force (e.g., intermolecular force (van der Waals attraction), a hydrogen bond, and hydrophobic interaction) works between one of the substances and the other substance. Usually, two substances that have interacted with each other are in an associated or bound state. The detection, the testing, and the diagnosis of the present invention can be achieved through the use of such interaction.

The term "binding" used herein means the physical interaction or chemical interaction between two substances or between their combinations. The binding includes an ionic bond, a non-ionic bond, a hydrogen bond, van der Waals binding, hydrophobic interaction, and the like. The physical interaction (binding) can be direct or indirect. The indirect binding is mediated by or attributed to the effects of another protein or compound. The direct binding refers to interaction that is neither mediated by nor attributed to the effects of another protein or compound and involves no other substantial chemical intermediates.

Thus, in the present specification, "agent" (or a detecting agent, etc.) "specifically" interacting with (or binding to) a biological agent such as a polynucleotide or a polypeptide encompasses an agent whose affinity for the biological agent such as the polynucleotide or the polypeptide is typically equivalent to or higher, preferably significantly (e.g., statistically significantly) higher, than its affinity for other unrelated polynucleotides or polypeptides (particularly, having less than 30% identity). Such affinity can be measured by, for example, hybridization assay or binding assay.

In the present specification, the phrase "first substance or agent "specifically" interacts with (or binds to) a second substance or agent" means that the first substance or agent interacts with (or binds to) the second substance or agent with higher affinity than that for substances or agents other than the second substance or agent (particularly, other substances or agents present in a sample containing the second substance or agent). Examples of the specific interaction (or binding) between substances or agents include, but are not limited to: the reactions between nucleic acids or proteins, such as hybridization for the nucleic acids, and antigen-antibody reaction and enzyme-substrate reaction for the proteins; and protein-lipid interaction and nucleic acid-lipid interaction. Thus, in the case where both of the substances or agents are nucleic acids, the "specific interaction" of the first substance or agent with the second substance or agent encompasses the case where the first substance or agent has complementarity to at least a portion of the second substance or agent. Alternatively, in the case where both of the substances or agents are proteins, examples of the "specific" interaction (or binding) of the first substance or agent with (or to) the second substance or agent include, but are not limited to, interaction through antigen-antibody reaction, interaction through receptor-ligand reaction, and enzyme-substrate interaction. In the case where two types of substances or agents comprise proteins and nucleic acids, the "specific" interaction (or binding) of the first substance or agent with (or to) the second substance or agent encompasses the interaction (or binding) between an antibody and its antigen. An analyte in a sample can be detected or quantified through the use of the reaction of such specific interaction or binding.

In the present specification, "detection" or "quantification" of polynucleotide or polypeptide expression can be achieved by use of an appropriate method including, for example, mRNA assay and immunological assay methods involving binding to or interaction with a detecting agent, a testing agent, or a diagnostic agent. Examples of the molecular biological assay method include Northern blot, dot blot, and PCR. Examples of the immunological assay method include methods such as ELISA using microtiter plates, RIA, fluorescence immunoassay, luminescence immunoassay (LIA), immunoprecipitation (IP), single radial immunodiffusion (SRID), turbidimetric immunoassay (TIA), Western blot, and immunohistological staining. Examples of the quantification method include ELISA and RIA. The detection or the quantification may be performed by a gene analysis method using an array (e.g., a DNA array and a protein array). The DNA array is broadly reviewed in (Gakken Medical Shujunsha Co., Ltd. ed., Cell Engineering, Suppl., "DNA microarray and latest PCR methods"). The protein array is described in detail in Nat Genet. 2002 December; 32 Suppl: 526-532. Examples of the gene expression analysis method include, but are not limited to, RT-PCR, RACE, SSCP, immunoprecipitation, two-hybrid systems, and in vitro translation, in addition to those mentioned above. Such an additional analysis method is described in, for example, Genomu Kaiseki Jikken Ho (Experimental Methods for Genomic Analysis in English), Nakamura Lab Manual, Yusuke Nakamura, ed., Yodosha Co., Ltd. (2002), the description of which is incorporated herein by reference in its entirety.

In the present specification, "expression level" refers to the amount of a polypeptide or mRNA, etc. expressed in intended cells, tissues, or the like. Examples of such an expression level include the expression level at the protein level of the polypeptide of the present invention evaluated by any appropriate method including an immunological assay method such as ELISA, RIA, fluorescence immunoassay, Western blot, or immunohistological staining using the antibody of the present invention, and the expression level at the mRNA level of the polypeptide of the present invention evaluated by any appropriate method including a molecular biological assay method such as Northern blot, dot blot, or PCR. "Change in expression level" means increase or decrease in the expression level at the protein or mRNA level of the polypeptide of the present invention evaluated by any appropriate method including the immunological assay method or molecular biological assay method described above. The expression level of a certain marker can be measured to thereby variously conduct detection or diagnosis based on the marker.

In the present specification, "decrease" or "suppression", or its synonym of activity or an expression product (e.g., a protein and a transcript (RNA, etc.)) refers to decrease in the amount, quality, or effect of the particular activity, transcript, or protein, or decreasing activity thereagainst. In the case where the decrease results in "disappearance", the decrease means that the activity, the expression product, etc. becomes less than the detection limit, and is also particularly referred to as "disappearance". In the present specification, "disappearance" is encompassed by "decrease" or "suppression".

In the present specification, "increase" or "activation", or its synonym of activity or an expression product (e.g., a protein and a transcript (RNA, etc.)) refers to increase in the amount, quality, or effect of the particular activity, transcript, or protein, or increasing activity thereagainst.

In the present specification, "in vivo" refers to the inside of a living body. In a particular context, "in vivo" refers to a position at which an intended substance should be located.

In the present specification, "in vitro" refers to a state in which a portion of a living body is extracted or liberated to the "outside of the living body" (e.g., into a test tube) for various studies. This term makes a contrast with the term "in vivo".

In the present specification, "ex vivo" refers to a series of operations when a certain procedure is performed outside the body and the resultant is intended to be then brought back to the body. In the present invention as well, an embodiment is possible in which cells present in a living body are treated with the agent of the present invention and then brought back to the patient.

In the present specification, "combined use" of a certain pharmaceutical ingredient (e.g., the antibody of the present invention, for example, the anti-FSTL1 antibody) with another pharmaceutical ingredient (e.g., the anti-PD-L1 antibody) is intended to include concurrent (coexistent) administration and continuous administration. The continuous administration is intended to encompass the administration of one or more therapeutic agents and one or more antibodies, etc. of the present invention to a recipient in various orders.

An agent or drug for administration by "combined use" of a certain pharmaceutical ingredient (e.g., the antibody of the present invention, for example, the anti-FSTL1 antibody) with another pharmaceutical ingredient (e.g., the anti-PD-L1 antibody) is also called "combination drug".

In the present specification, "kit" usually refers to a unit by which parts to be provided (e.g., a testing drug, a diagnostic drug, a therapeutic drug, an antibody, a label, and a written explanation) are provided in two or more divided compartments. This kit form is preferred when the parts should not be provided as a mixture for stability or the like and are intended to be mixed immediately before use to provide a preferred composition. For such a kit, it is advantageous to comprise, preferably, an instruction manual or a written explanation that describes how to use the parts to be provided (e.g., a testing drug, a diagnostic drug, and a therapeutic drug or how to treat reagents. In the present specification, in the case of using the kit as a reagent kit, the kit usually comprises an instruction manual or the like that describes how to use a testing kit, a diagnostic drug, a therapeutic drug, an antibody, etc.

In the present specification, "instruction manual" is a statement that explains a method used in the present invention to physicians or other users. This instruction manual describes words providing instructions for the detection method of the present invention, how to use a diagnostic drug, or the administration of a medicament or the like. Also, the instruction manual may describe words providing instructions for oral administration or administration to the esophagus (e.g., by injection) as an administration route. This instruction manual is prepared according to a format specified by regulatory authorities of a country (e.g., Ministry of Health, Labour and Welfare for Japan and Food and Drug Administration (FDA) for the U.S.A) where the present invention is executed, and stipulates that approval by the regulatory authorities has been received. The instruction manual is a so-called package insert and is usually provided in a paper version, though the instruction manual is not limited thereto. The instruction manual may be provided in the form of, for example, an electronic medium (e.g., homepage provided by the Internet, and e-mail).

Preferred Embodiments

Hereinafter, preferred embodiments of the present invention will be described. It is understood that the embodiments provided below are given for well understanding the present invention, and the scope of the present invention should not be limited to the description below. Thus, it is evident that those skilled in the art can appropriately make change or modification within the scope of the present invention in light of the description of the present specification. It is also understood that the following embodiments of the present invention can each be used alone or can be used in combination.

(Anti-FSTL1 Antibody)

In one aspect, the present invention provides an anti-FSTL1 antibody or a fragment or functional equivalent thereof (also collectively referred herein to as "anti-FSTL1 antibody, etc." or "antibody, etc. of the present invention"), wherein the antibody recognizes an epitope in a region selected from the group consisting of amino acid positions 48 to 100, 148 to 170 or 148 to 162, 193 to 228 or 193 to 216, 205 to 228, and 233 to 289 or 272 to 289 of SEQ ID NO: 251 (amino acid sequence of human FSTL1). In a preferred embodiment, the antibody recognizes an epitope in a region of amino acid positions 148 to 162 or 272 to 289 of SEQ ID NO: 251 (amino acid sequence of human FSTL1).

For the antibody according to the present invention, the epitope can correspond to a region of consecutive or non-consecutive 5 or more amino acids, 6 or more amino acids, 7 or more amino acids, 8 or more amino acids, 9 or more amino acids, 10 or more amino acids, 11 or more amino acids, or 12 or more amino acids in the region concerned, or a combination thereof.

In a preferred embodiment, the antibody for the anti-FSTL1 antibody of the present invention or the fragment or functional equivalent thereof recognizes an epitope in a region selected from the group consisting of amino acid positions 48 to 100, 148 to 162, 205 to 228, and 272 to 289 of SEQ ID NO: 250 (amino acid sequence of human FSTL1). These epitopes include those for which drug efficacy has been confirmed in animal tests. It is understood that #6-55, #7-34, and #13 recognize the 148-162 site. It is also understood that #5-2, #5-3, #5-8, #5-10, #5-43, #8-1, #8-4, #8-6, and #8-8 recognize amino acid positions 272 to 289. It is understood that #7 and #10 recognize amino acid positions 205 to 228. It is understood that #22 recognizes amino acid positions 193 to 216. It is understood that #33 recognizes amino acid positions 48 to 100. Further preferably, the antibody for the anti-FSTL1 antibody of the present invention or the fragment or functional equivalent thereof recognizes an epitope in a region selected from the group consisting of amino acid positions 148 to 162 and 205 to 228 of SEQ ID NO: 250 (amino acid sequence of human FSTL1). These epitopes include those recognized by antibodies confirmed to have stronger activity. In another preferred embodiment, the antibody recognizes an epitope in a region of amino acid positions 48 to 100, 148 to 162, or 205 to 228 of SEQ ID NO: 251 (amino acid sequence of human FSTL1). Although not wishing to be bound by any theory, these epitopes include those for which drug efficacy has been confirmed in in vitro or in vivo tests.

In an alternative embodiment, the antibody for the anti-FSTL1 antibody of the present invention or the fragment or functional equivalent thereof has particular CDR. Alternatively, the anti-FSTL1 antibody of the present invention or the fragment or functional equivalent thereof may be an antibody comprising an arbitrary sequence comprising a full-length CDR sequence, or an antigen binding fragment thereof, or an antibody comprising the variable region of a sequence related to a particular antibody of the present invention, or an antigen binding fragment thereof, wherein a framework region thereof contains the substitution, addition, or deletion of 1, 2, 3, 4, 5, 6, 7, 8, 9, 10, 12, 15, 17, or 20 or more amino acids. More specifically, as for such particular CDR, the antibody comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of antibody #5-2 (light chain: SEQ ID NO: 255; heavy chain: SEQ ID NO: 257), #5-3 (light chain: SEQ ID NO: 259; heavy chain: SEQ ID NO: 261), antibody #5-8 (light chain: SEQ ID NO: 263; heavy chain: SEQ ID NO: 265), #5-10 (light chain: SEQ ID NO: 267; heavy chain: SEQ ID NO: 269), #5-43 (light chain: SEQ ID NO: 271; heavy chain: SEQ ID NO: 273), #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #8-4 (light chain: SEQ ID NO: 287; heavy chain: SEQ ID NO: 289), #8-7 (light chain: SEQ ID NO: 291; heavy chain: SEQ ID NO: 293), #8-8 (light chain: SEQ ID NO: 295; heavy chain: SEQ ID NO: 297), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309), #22 (light chain: SEQ ID NO: 311; heavy chain: SEQ ID NO: 312) and #33 (light chain: SEQ ID NO: 315; heavy chain: SEQ ID NO: 317) or functional equivalents thereof (e.g., containing the conservative substitution of 1, 2, or 3 or more amino acids) as specific examples of heavy chain CDR1, CDR2, and CDR3 and light chain CDR1, CDR2, and CDR3. Alternatively, the anti-FSTL1 antibody of the present invention or the fragment or functional equivalent thereof may be a mutant of the antibody, wherein the mutant contains the substitution, addition, or deletion of 1 or several amino acids in a framework of the antibody but contains no mutation in the CDR. Embodiments described in another section herein and/or an approach known in the art can be used in the production of the antibody, etc. For the treatment or prevention of the present invention, it is preferred that such an antibody or a fragment or functional equivalent thereof should have suppressive activity against FSTL1 or a signaling pathway downstream therefrom. Such activity may be confirmed by examining the expression level of FSTL1 or its activity, or by directly using a cancer cell line and examining, for example, the inhibition of cell growth, the inhibition of metastatic activity, the inhibition of bone metastasis, the inhibition of the activity of enhancing immune defect such as immunosuppression or immunodeficiency by MSCs (e.g., growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity), the inhibition of imparting of immunosuppressive or immunodeficient properties to immune-related cells (e.g., growth of regulatory T cells, increase in the immunosuppressive activity of regulatory T cells, differentiation into regulatory T cells, growth of regulatory dendritic cells, increase in the immunosuppressive activity of regulatory dendritic cells, differentiation into regulatory dendritic cells, growth of tolerogenic dendritic cells, increase in the immunosuppressive activity of tolerogenic dendritic cells, differentiation into tolerogenic dendritic cells, growth of myeloid-derived suppressor cells, increase in the immunosuppressive activity of myeloid-derived suppressor cells, differentiation into myeloid-derived suppressor cells, growth of exhausted T cells, enhancement of the immunodeficient activity of exhausted T cells, and expansion of exhausted T cells caused by growth, induction, etc. of exhausted T cells, cytotoxic activity by antibody-dependent cellular cytotoxicity (ADCC), or observed retraction of tumor implanted in model animals. An approach therefor is well known in the art, and an approach used herein may be used. In a particular embodiment, such an antibody of the present invention can be an antibody selected from a monoclonal antibody, a polyclonal antibody, a chimeric antibody, a humanized antibody, a human antibody, a multifunctional antibody, a bispecific or oligospecific antibody, a single-chain antibody, scFv, diabody, sc(Fv)$_2$ (single chain (Fv)2), and scFv-Fc.

Herein, the amino acid sequences of CDRs of each antibody clone are underlined in the sequences of heavy and light chains.

5-2:
Light chain (L chain; SEQ ID NO: 255): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>

<u>PS</u>DIPSRFSGSKSGSTATLTITGVQAEDEAVYFC<u>GGYDSSTGHGGI</u>FGAG

TTLTVL

Heavy chain (H chain; SEQ ID NO: 257): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G</u>

<u>VGKDGGTGYGAAVDGRATISKDNGQSTLRLQLNNLRAEDTGTYYCAK</u><u>AAG</u>

<u>GCSYGWCGSYVGDIDAW</u>GHGTEVIVSS

5-3
L chain (SEQ ID NO: 259): CDRs are underlined, and CDR1, CDR2, and CDR3 are shown in order from the N terminus.

ASTQPSSVSANPGETVKITC<u>SGGSYGYYYG</u>WYQQKSPGSVPVTVIY<u>NNNN</u>

<u>RP</u>SDIPSRFSGSKSGSTGTLTITGVRAEDEAVYYC<u>GGYDNSGTGI</u>FGAGT

TLTVL

H chain (SEQ ID NO: 261): CDRs are underlined, and CDR1, CDR2, and CDR3 are shown in order from the N terminus.

AVTLDESGGGLQTPGGALSLVCKGSGFSFS<u>SFNMF</u>WVRQAPGKGLEWVA<u>G</u>

<u>IGKDGVPKYGAAVDGRATISKDNGQSTMRLQLNNLRAEDTGTYFCAK</u><u>AAG</u>

<u>GCSYDWCGIYAGDIDTW</u>GHGTEVIVSS

5-8
L chain (SEQ ID NO: 263): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>

<u>PS</u>DIPSRFSGSKSGSTATLTITGVQAEDEAVYFC<u>GGYDSSTGHGGI</u>FGAG

TTLTVL

H chain (SEQ ID NO: 265): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G</u>

<u>IGKDGVPKYGTAVDGRATISKDNGQSTMRLQLNNLRAEDTGTYFCAK</u><u>AAG</u>

<u>GCSYDWCGIYTGDIDTW</u>GHGTEVIVSS

5-10
L chain (SEQ ID NO: 267): CDRs are underlined, and CDR1, CDR2, and CDR3 are shown in order from the N terminus.

ASTQPSSVSANPGETVKITC<u>SGGGSYVGSYYYG</u>WYQQKSPGSAPVTVIY<u>NNNQRPS</u>DIPSRFSGSKSGSTATLTITGVQAEDEAVYFC<u>GGYDSSAGGI</u>FGAGTTLVTVL

H chain (SEQ ID NO: 269): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVAG<u>VGKDGGTTYGAAVDG</u>RATISRDSGQSTVRLQLNDLRAEDTGTYFCAK<u>AAGGCSYSWCGAYVGDLDA</u>WGHGTEVIVSS

5-43
L chain (SEQ ID NO: 271): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQRPS</u>DIPSRFSGSKSGSTATLTITGVQAEDEAVYFC<u>GGYDSSTGHGGI</u>FGAGTTLTVL

H chain (SEQ ID NO: 273): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVAG<u>IGKDGGTGYGAAVDG</u>RATISKDSGQSTLRLQLNNLRAEDTGTYYCAK<u>AAGGCSYDWCGAYTGDIDT</u>WGHGTEVIVSS

6-55
L chain (SEQ ID NO: 275): CDRs are underlined, and CDR1, CDR2, and CDR3 are shown in order from the N terminus.

ASTQPSSVSAIPGETVKITC<u>SGGGNNYG</u>WYQQRSPGSAPVTVIY<u>YNDNRPS</u>NIPSRFSGSTSGSTSTLTITGVQADDEAIYYC<u>GSWDSNTDSGI</u>FGAGTTLTVL

H chain (SEQ ID NO: 277): CDRs are underlined, and CDR1, CDR2, and CDR3 are shown in order from the N terminus.

AVTLDESGGGLQTPGGALSLVCKGSGFTFT<u>SVTMQ</u>WVRQAPGKGLEWVAS<u>VCSGSSTYYAPAVKG</u>RATISRDNGQSTVRLQLSNLRPEDTGTYYCAK<u>IAGRARWSCTSAAYNIDA</u>WGHGTEVIVSS

7-34
L chain (SEQ ID NO: 279): CDRs are underlined, and CDR1, CDR2, and CDR3 are shown in order from the N terminus.

ASTQPSSVSANPGETVKITC<u>SGGGNNYG</u>WYQQKSPGSAPVTVIY<u>YNNNRPS</u>NIPSRFSGSTSGSTSTLTITGVQAEDEAVYYC<u>GSYEGSTDSGI</u>FGAGTTLTVL

H chain (SEQ ID NO: 281): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVAS<u>ICSGSSTYYGPAVKG</u>RATISRDNGQNTVRLQLNNLRAEDTATYYCAK<u>IVGRGRWSCTSAAYNIDA</u>WGHGTEVIVSS

8-1
L chain (SEQ ID NO: 283): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQRPS</u>DIPSRFSGSKSGSTATLTITGVQAEDEAVYFC<u>GGYDSSSGHGGI</u>FGAGTTLTVL

H chain (SEQ ID NO: 285): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVAG<u>IGKDGVPKYGAAVDG</u>RATISKDNGQSTMRLQLNNLRAEDTGTYFCAK<u>AAGGCSYDWCGIYAGDIDT</u>WGHGTEVIVSS

8-4
L chain (SEQ ID NO: 287): CDRs are underlined, and CDR1, CDR2, and CDR3 are shown in order from the N terminus.

ASSQPSSVSANPGETVKITC<u>SGGSGYYYG</u>WYQQKSPGSAPVTVIY<u>NNDNKPS</u>DIPSRFSGSKSGSTGTLTITGVQVEDEAVYFC<u>GGYDNSGTGI</u>FGAGTTLTVL

H chain (SEQ ID NO: 289): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVAG<u>VGKDGGTAYGAAVDG</u>RATISRDSGQSTVRLQLNNLRAEDTGTYFCAK<u>AAGGCSYSWCGAYVGDLDA</u>WGHGTEVIVSS

8-7
L chain (SEQ ID NO: 291): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQRPS</u>DIPSRFSGSKSGSTATLTITGVQAEDEAVYFC<u>GGYDSSTGHGGI</u>FGAGTTLTVL

H chain (SEQ ID NO: 293): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G</u>
<u>IGKDGVPKYGAAVDG</u>RATISKDNGQSTLTLQLNNLRAEDTGTYFCAK<u>AAG</u>
<u>GCSYDWCGIYAGDIDT</u>WGHGTEVIVSS

8-8
L chain (SEQ ID NO: 295): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>
<u>PS</u>DIPSRFSGSKSGSTATLTITGVQVEDEAVYFC<u>GGYDSSTGHGGI</u>FGAG
TTLTVL

H chain (SEQ ID NO: 297): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVA<u>G</u>
<u>IGKDGVPKYGAAVDG</u>RATISKDNGQSTMRLQLNNLRAEDTGTYYCAK<u>AAG</u>
<u>GCSYGWCGAYTGDIDT</u>WGHGTEVIVSS

7
L chain (SEQ ID NO: 299): CDRs are underlined, and CDR1, CDR2, and CDR3 are shown in order from the N terminus.

ASTQPSSVSANPGETVKITC<u>SGGGSRYG</u>WYQQKSPGSAPVTVIY<u>YNDKRP</u>
<u>S</u>NIPSRFSGSKSGSTGTLTITGVRAEDEAVYFC<u>GGYDGSTDAAF</u>GAGTTL
TVL

H chain (SEQ ID NO: 301): CDRs are underlined, and CDR1, CDR2, and CDR3 are shown in order from the N terminus.

AVTLDESGGGLQTPGGALSLVCKASGFFFF<u>SIYDMG</u>WVRQAPGKGLEWVA
<u>GIDDYGEYTGYGSAVK</u>GRATISRDNGQSTVRLQLNNLRAEDTGTYYCAR<u>G</u>
<u>AGTGCNSAGCGAYAGSIDA</u>WGHGTEVIVSP

10
L chain (SEQ ID NO: 303): CDRs are underlined, and CDR1, CDR2, and CDR3 are shown in order from the N terminus.

ASTQPSSVSANPGETVKLTC<u>SGGGSRYG</u>WYQQKSPGSAPVTVIY<u>YNDKRP</u>
<u>S</u>DIPSRFSGSKSGSTATLTITGVQAEDEAVYFC<u>GGYDGSRDAGI</u>FGAGTT
LTVL

H chain (SEQ ID NO: 305): CDRs are underlined, and CDR1, CDR2, and CDR3 are shown in order from the N terminus.

AVTLDESGGGLQTPGGALSLVCKASGFFFF<u>RIYDMG</u>WVRQAPGKGLEWVA
<u>GIDDYGRYTGYGSAVK</u>GRATISRDNGQSTVRLQLNNLRAEDTGTYYCAR<u>G</u>
<u>AGTGCNSAGCGAYAGSIDA</u>WGHGTEVIVSS

13
L chain (SEQ ID NO: 307): CDRs are underlined, and CDR1, CDR2, and CDR3 are shown in order from the N terminus.

ASTQPSSVSANPGETVKITC<u>SGGGNNYG</u>WYQQKSPGSAPVTVIY<u>NNNNRP</u>
<u>S</u>NIPSRFSGSKSGSTNTLTITGVQAEDEAVYYC<u>GSYDSSSDSGI</u>FGAGTT
LTVL

H chain (SEQ ID NO: 309): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVA<u>S</u>
<u>ICSGSSTYYGPAVK</u>GRATISRDNGQNTVRLQLNNLRAEDTATYYCAK<u>IVG</u>
<u>RGRWSCTSAAYNIDA</u>WGHGTEVIVSS

22
L chain (SEQ ID NO: 311): CDRs are underlined, and CDR1, CDR2, and CDR3 are shown in order from the N terminus.

ASTQPSSVSANPGETVKITC<u>SGGSGSYG</u>WFQQKSPGSAPVTVIY<u>WDDRR</u>
<u>PS</u>DIPSRFSGSKSGSIHTLTITGVQADDEAVYLC<u>GNAVRSGTGYVGV</u>FG
AGTTLTVL

H chain (SEQ ID NO: 313): CDRs are underlined, and CDR1, CDR2, and CDR3 are shown in order from the N terminus.

AVTLDESGGGLQTPGGALSLVCKASGFTFS<u>SNGMA</u>WVRQAPGKGLELVA<u>R</u>
<u>INSSGSYTNYGAAVK</u>GRATISRDNGQSTVRLQLNNLRAEDTGTYYCAK<u>GA</u>
<u>SGYGAYPGNIDA</u>WGHGTEVIVSS

33
L chain (SEQ ID NO: 315): CDRs are underlined, and CDR1, CDR2, and CDR3 are shown in order from the N terminus.

ASTQPSSVSANPGETVEITC<u>SGDSSYYG</u>WFQQKSPGSAPVTVIY<u>DNTNRP</u>
<u>S</u>DIPSRFSGSKSGSTATLTITGVRAEDEAVYYC<u>GGYDSSTYDGI</u>FGAGTT
LTVL

H chain (SEQ ID NO: 317): CDRs are underlined, and CDR1, CDR2, and CDR3 are shown in order from the N terminus.

AVTLDESGGGLQTPGGGLSLVCKASGFTFS<u>SFNMN</u>WVRQAPGKGLEYVA<u>E</u>
<u>ISGTGSSTYYGSAVK</u>GRATISRDNGQSTVRLQLNNLRAEDTATYFCAR<u>GD</u>
<u>GAYSIDA</u>WGHGTEVIVSS

In a preferred embodiment, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317) or functional equivalents thereof (e.g., containing the conservative substitution of 1, 2, or 3 or more amino acids). In these clones, stronger binding activity against FSTL1 was observed in Examples. It is understood that a clone carrying similar CDRs is expected to maintain this stronger binding activity, and exerts similar drug efficacy.

Further preferably, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 275; heavy chain: SEQ ID NO: 277), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317) or functional equivalents thereof (e.g., containing the conservative substitution of 1, 2, or 3 or more amino acids). In these clones, stronger drug efficacy was observed in Examples. It is understood that a clone carrying similar CDRs is expected to maintain this stronger drug efficacy.

In an alternative embodiment, the antibody for the anti-FSTL1 antibody of the present invention or the fragment or functional equivalent thereof has particular full-length variable regions. Such particular variable regions include the full-length variable regions of antibody #5-2 (light chain: SEQ ID NO: 255; heavy chain: SEQ ID NO: 257), #5-3 (light chain: SEQ ID NO: 259; heavy chain: SEQ ID NO: 261), antibody #5-8 (light chain: SEQ ID NO: 263; heavy chain: SEQ ID NO: 265), #5-10 (light chain: SEQ ID NO: 267; heavy chain: SEQ ID NO: 269), #5-43 (light chain: SEQ ID NO: 271; heavy chain: SEQ ID NO: 273), #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #8-4 (light chain: SEQ ID NO: 287; heavy chain: SEQ ID NO: 289), #8-7 (light chain: SEQ ID NO: 291; heavy chain: SEQ ID NO: 293), #8-8 (light chain: SEQ ID NO: 295; heavy chain: SEQ ID NO: 297), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309), #22 (light chain: SEQ ID NO: 311; heavy chain: SEQ ID NO: 313) and #33 (light chain: SEQ ID NO: 315; heavy chain: SEQ ID NO: 317) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises the full-length variable regions of an antibody selected from the group consisting of #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317) or functional equivalents thereof (e.g., containing the conservative substitution of 1, 2, or 3 or more amino acids). In a preferred embodiment, the antibody for the anti-FSTL1 antibody of the present invention or the fragment or functional equivalent thereof comprises the full-length variable regions of an antibody selected from the group consisting of antibody #6-55 (light chain: SEQ ID NO: 275; heavy chain: SEQ ID NO: 277), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises a full-length antibody selected from the group consisting of antibody #5-2 (light chain: SEQ ID NO: 345; heavy chain: SEQ ID NO: 347), #5-3 (light chain: SEQ ID NO: 349; heavy chain: SEQ ID NO: 351), antibody #5-8 (light chain: SEQ ID NO: 353; heavy chain: SEQ ID NO: 355), #5-10 (light chain: SEQ ID NO: 357; heavy chain: SEQ ID NO: 359), #5-43 (light chain: SEQ ID NO: 361; heavy chain: SEQ ID NO: 363), #6-55 (light chain: SEQ ID NO: 365; heavy chain: SEQ ID NO: 367), #7-34 (light chain: SEQ ID NO: 369; heavy chain: SEQ ID NO: 371), #8-1 (light chain: SEQ ID NO: 373; heavy chain: SEQ ID NO: 375), #8-4 (light chain: SEQ ID NO: 377; heavy chain: SEQ ID NO: 379), #8-7 (light chain: SEQ ID NO: 381; heavy chain: SEQ ID NO: 383), #8-8 (light chain: SEQ ID NO: 385; heavy chain: SEQ ID NO: 387), #7 (light chain: SEQ ID NO: 389; heavy chain: SEQ ID NO: 391), #10 (light chain: SEQ ID NO: 393; heavy chain: SEQ ID NO: 395), #13 (light chain: SEQ ID NO: 397; heavy chain: SEQ ID NO: 399), #22 (light chain: SEQ ID NO: 401; heavy chain: SEQ ID NO: 403) and #33 (light chain: SEQ ID NO: 405; heavy chain: SEQ ID NO: 407) or a humanized sequence thereof.

In a preferred embodiment, the antibody for the anti-FSTL1 antibody of the present invention or the fragment or functional equivalent thereof comprises a full-length antibody selected from the group consisting of antibody #6-55 (light chain: SEQ ID NO: 365; heavy chain: SEQ ID NO: 367), #7-34 (light chain: SEQ ID NO: 369; heavy chain: SEQ ID NO: 371), #8-1 (light chain: SEQ ID NO: 373; heavy chain: SEQ ID NO: 375), #7 (light chain: SEQ ID NO: 389; heavy chain: SEQ ID NO: 391), #10 (light chain: SEQ ID NO: 303; heavy chain: SEQ ID NO: 305), #13 (light chain: SEQ ID NO: 397; heavy chain: SEQ ID NO: 399) and #33 (light chain: SEQ ID NO: 405; heavy chain: SEQ ID NO: 407) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 275; heavy chain: SEQ ID NO: 277), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 255; heavy chain: SEQ ID NO: 257) or a humanized sequence thereof.

In a preferred embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 418, 420, 422, and 424, respectively) and L chain FR1, FR2, FR3, and FR4 (SEQ ID NOs: 434, 436, 438, and 440, respectively) of H(2)-L(1).

In a preferred embodiment, the humanized antibody of the present invention has a heavy chain framework sequence comprising SEQ ID NOs: 410, 412, 414, and 416 (humanized heavy chain sequence FR1, FR2, FR3, and FR4 of H(1)), SEQ ID NOs: 418, 420, 422, and 424 (humanized heavy chain sequence FR1, FR2, FR3, and FR4 of H(2)), or SEQ ID NOs: 426, 428, 430, and 432 (humanized heavy chain sequence FR1, FR2, FR3, and FR4 of H(3)), and a light chain framework sequence comprising SEQ ID NOs: 434, 436, 438, and 440 (humanized light chain sequence FR1, FR2, FR3, and FR4 of L(1)), SEQ ID NOs: 480, 482, 484, and 486 (humanized light chain sequence FR1, FR2, FR3, and FR4 of L(2)), or SEQ ID NOs: 488, 490, 492, and 494 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 455, 456, 457, and 458, respectively) and light chain sequence FR1, FR2, FR3, and FR4 (SEQ ID NOs: 459, 460 or 463, 461 or 464, and 462, respectively) of corresponding chicken sequences, into amino acids in each of the chicken sequences. Preferably, the heavy chain framework sequence of H(2), i.e., SEQ ID NOs: 418, 420, 422, and 424 (humanized heavy chain sequence FR1, FR2, FR3, and FR4 of H(2)), or a sequence obtained by the mutation (back mutation) of one or more differing amino acids in the heavy chain framework sequence from heavy chain sequence FR1, FR2, FR3, and FR4 of a corresponding chicken sequence, into amino acids in the chicken sequence can be used. In the present specification, this is because use of H(2) was superior in activity by an order of magnitude in terms of $K_D$ value to H(1) and H(3). Also preferably, a light chain framework sequence comprising SEQ ID NOs: 434, 436, 438, and 440 (humanized light chain sequence FR1, FR2, FR3, and FR4, respectively, of L(1)) or a sequence obtained by the mutation (back mutation) of one or more differing amino acids in the light chain framework sequence from corresponding chicken light chain sequence FR1, FR2, FR3, and FR4 (SEQ ID NOs: 459, 460 or 463, 461 or 464, and 462, respectively) into amino acids in the chicken sequence can be used.

Further preferably, the humanized antibody has a heavy chain framework sequence comprising SEQ ID NOs: 410, 412, 414, and 416 (humanized heavy chain sequence FRl, FR2, FR3, and FR4 of H(1)), SEQ ID NOs: 418, 420, 422, and 424 (humanized heavy chain sequence FR1, FR2, FR3, and FR4 of H(2)), or SEQ ID NOs: 426, 428, 430, and 432 (humanized heavy chain sequence FR1, FR2, FR3, and FR4 of H(3)), or a sequence obtained by the mutation of 1 to 8 (e.g., 1, 2, 3, 4, 5, 6, 7, or 8) differing amino acids in the heavy chain framework sequence from corresponding chicken heavy chain sequence FRl, FR2, FR3, and FR4 (SEQ ID NOs: 455, 456, 457, and 458, respectively) into amino acids in the chicken sequence, and has a light chain framework sequence comprising SEQ ID NOs: 434, 436, 438, and 440 (humanized light chain sequence FR1, FR2, FR3, and FR4 of L(1)), SEQ ID NOs: 480, 482, 484, and 486 (humanized light chain sequence FR1, FR2, FR3, and FR4 of L(2)), or SEQ ID NOs: 488, 490, 492, and 494 (humanized light chain sequence FR1, FR2, FR3, and FR4 of L(3)), or a sequence obtained by the mutation of 1 to 4 (e.g., 1, 2, 3, or 4) differing amino acids in the light chain framework sequence from corresponding chicken light chain sequence FR1, FR2, FR3, and FR4 (SEQ ID NOs: 459, 460 or 463, 461 or 464, and 462, respectively) into amino acids in the chicken sequence.

In a preferred embodiment, at least 1, more preferably at least 2, at least 3, at least 4, or at least 5 differing amino acids that are taken into consideration for the back mutation of the humanized antibody are selected from Vernier residues. It is understood that the mutation may involve amino acid residues other than the Vernier residues as long as the activity is optimized. In a preferred embodiment, all of the differing amino acids are selected from Vernier residues. For the Vernier residue, see, for example, Japanese Patent Laid-Open No. 2010-4895 and Nishibori N et al., Molecular Immunology 43 (2006) 634-642, the description of which is incorporated herein by reference.

The Vernier residues include FR1 amino acid (SEQ ID NO: 418) positions 28 and 30, FR2 amino acid (SEQ ID NO: 420) position 12, and FR3 amino acid (SEQ ID NO: 422) positions 2, 10, 13, 17, and 32 of the H chain of the humanized sequence, and FR1 (SEQ ID NO: 434) position 20 and FR3 amino acid (SEQ ID NO: 438) positions 10, 15, and 31 of the L chain. It is understood that the Vernier sequences may vary among different sequences.

In one embodiment, the antibody of the present invention is a humanized antibody having any of the H chain FR1, FR2, FR3, and FR4 and L chain FR1, FR2, FR3, and FR4 of H(1)-L(1), H(2)-L(1), H(3)-L(1), H(1)-L(2), H(2)-L(2), H(3)-L(2), H(1)-L(3), H(2)-L(3), or H(3)-L(3). In another embodiment, the antibody of the present invention is a humanized antibody having the H chain FR1, FR2, FR3, and FR4 (SEQ ID NOs: 418, 420, 422, and 424, respectively) and L chain FR1, FR2, FR3, and FR4 (SEQ ID NOs: 434, 436, 438, and 440, respectively) of H(2)-L(1).

In an alternative embodiment, the antibody of the present invention is a humanized antibody having a heavy chain framework sequence comprising SEQ ID NOs: 410, 412, 414, and 416 (humanized heavy chain sequence FR1, FR2, FR3, and FR4 of H(1)), SEQ ID NOs: 418, 420, 422, and 424 (humanized heavy chain sequence FR1, FR2, FR3, and FR4 of H(2)), or SEQ ID NOs: 426, 428, 430, and 432 (humanized heavy chain sequence FR1, FR2, FR3, and FR4 of H(3)), or a mutant containing the substitution, addition, and/or deletion of 1 to 10 amino acids thereof, and a light chain framework sequence comprising SEQ ID NOs: 434, 436, 438, and 440 (humanized light chain sequence FR1, FR2, FR3, and FR4 of L(1)), SEQ ID NOs: 480, 482, 484, and 486 (humanized light chain sequence FR1, FR2, FR3, and FR4 of L(2)), or SEQ ID NOs: 488, 490, 492, and 494 (humanized light chain sequence FR1, FR2, FR3, and FR4 of L(3)), or a mutant containing the substitution, addition, and/or deletion of 1 to 10 amino acids thereof.

In a further alternative embodiment, the antibody of the present invention is a humanized antibody comprising a framework sequence consisting of a heavy chain framework sequence comprising SEQ ID NOs: 410, 412, 414, and 416 (humanized heavy chain sequence FR1, FR2, FR3, and FR4 of H(1)), SEQ ID NOs: 418, 420, 422, and 424 (humanized heavy chain sequence FR1, FR2, FR3, and FR4 of H(2)), or SEQ ID NOs: 426, 428, 430, and 432 (humanized heavy chain sequence FR1, FR2, FR3, and FR4 of H(3)), and a light chain framework sequence comprising SEQ ID NOs: 434, 436, 438, and 440 (humanized light chain sequence FR1, FR2, FR3, and FR4), SEQ ID NOs: 480, 482, 484, and 486 (humanized light chain sequence FR1, FR2, FR3, and FR4 of L(2)), or SEQ ID NOs: 488, 490, 492, and 494 (humanized light chain sequence FR1, FR2, FR3, and FR4 of L(3)), or a sequence containing the substitution, addition, and/or deletion of 1 to 10 amino acids, 1 to 9 amino acids, 1 to 8 amino acids, 1 to 7 amino acids, 1 to 6 amino acids, 1 to 5 amino acids, 1 to 4 amino acids, 1 to 3 amino acids, or 1 or 2 amino acids in the framework sequence.

A transformant can be prepared by transfecting a cell with a polynucleotide or vector encoding the antibody for the anti-FSTL1 antibody according to one embodiment of the present invention or the fragment or functional equivalent thereof. Use of this transformant permits preparation of the antibody for the anti-FSTL1 antibody according to the embodiments of the present invention or the fragment or functional equivalent thereof. The transformant may be a human or non-human mammalian (e.g., rat, mouse, guinea pig, rabbit, bovine, and monkey) cell. Examples of the mammalian cell include Chinese hamster ovary cells (CHO cells) and monkey cells COS-7. Alternatively, the transformant may be a bacterium of the genus *Escherichia*, a yeast, or the like.

For example, an *E. coli*-derived plasmid (e.g., pET-Blue), a *Bacillus subtilis*-derived plasmid (e.g., pUB110), a yeast-derived plasmid (e.g., pSH19), an expression plasmid for animal cells (e.g., pA1-11 and pcDNA3.1-V5/His-TOPO), a bacteriophage such as λ, phage, or a virus-derived vector can be used as the vector described above. These vectors may contain a constituent necessary for protein expression, such as a promoter, a replication origin, or an antibiotic resistance gene. The vector may be an expression vector.

For example, a calcium phosphate method, lipofection, electroporation, an adenovirus-based method, a retrovirus-based method, or microinjection can be used as a method for transfecting the cell with the polynucleotide or vector described above (Shin Idenshi Kogaku Handobukku (New Gene Engineering Handbook in English), revised 4th edition, Yodosha Co., Ltd. (2003): 152-179). For example, a method described in "Tanpakushitsu Jikken Handobukku (Protein Experiment Handbook in English), Yodosha Co., Ltd. (2003): 128-142" can be used as a method for producing the antibody using cells. For example, ammonium sulfate, ethanol precipitation, protein A, protein G, gel filtration chromatography, anion- or cation-exchange chromatography, phosphocellulose chromatography, hydrophobic interaction chromatography, affinity chromatography, hydroxyapatite chromatography, or lectin chromatography can be used in the purification of the antibody (Tanpakushitsu Jikken Handobukku (Protein Experiment Handbook in English), Yodosha Co., Ltd. (2003): 27-52).

(Medicament and Anticancer Agent)

In one aspect, the present invention provides a medicament comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the medicament of the present invention.

In this aspect, the present invention provides the anti-FSTL1 antibody of the present invention or the fragment or functional equivalent thereof for use as a medicament. It is understood that an antibody of an arbitrary embodiment or arbitrary example described herein in the section (Anti-FSTL1 antibody), etc. can be used as the antibody or the fragment or functional equivalent thereof for use in the medicament of the present invention.

In this aspect, the present invention provides a method for treating or preventing a FSTL1-related disease, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides an anticancer agent comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the anticancer agent of the present invention.

In this aspect, the present invention provides the anti-FSTL1 antibody of the present invention or the fragment or functional equivalent thereof for the treatment or prevention of cancer. It is understood that an antibody of an arbitrary embodiment or arbitrary example described herein in the section (Anti-FSTL1 antibody), etc. can be used as the antibody or the fragment or functional equivalent thereof for the treatment or prevention of cancer of the present invention.

In this aspect, the present invention provides a method for treating or preventing cancer, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides a therapeutic or prophylactic agent for metastatic malignant tumor or metastasis of malignant tumor, comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof for the metastatic malignant tumor of the present invention.

In this aspect, the present invention provides the anti-FSTL1 antibody of the present invention or the fragment or functional equivalent thereof for the treatment or prevention of metastatic malignant tumor or metastasis of malignant tumor. It is understood that an antibody of an arbitrary embodiment or arbitrary example described herein in the section (Anti-FSTL1 antibody), etc. can be used as the antibody or the fragment or functional equivalent thereof for use in the treatment of metastatic malignant tumor of the present invention.

In this aspect, the present invention provides a method for treating or preventing metastatic malignant tumor or metastasis of malignant tumor, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

The disease targeted by the present invention is cancer. Examples thereof can include, but are not limited to, melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, and metastatic malignant tumor thereof. The cancer may be a cancer type highly expressing SNAIL and/or FSTL1. As for the expression of SNAIL and/or FSTL1, information obtained in the human tumor tissue analysis information site of Oncomine (see Table 1A in FIG. 126) provided by oncomine.com/resource/login.html explains that high expression is found in melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma. Therefore, it is understood that effects similar to those demonstrated in Examples are also produced for these cancer types.

(Oncomine Data)

In an alternative aspect, the present invention provides an inhibitor of metastasis of cancer cells, comprising the anti-FSTL1 antibody of the present invention or the fragment or functional equivalent thereof, and provides an inhibitor capable of inhibiting even bone metastasis, lung metastasis, liver metastasis, spleen metastasis, lymph node metastasis, or brain metastasis, particularly, bone metastasis or lung metastasis.

In this aspect, the present invention provides the anti-FSTL1 antibody of the present invention or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells. It is understood that an antibody of an arbitrary embodiment or arbitrary example described herein in the section (Anti-FSTL1 antibody), etc. can be used as the antibody or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells, according to the present invention.

In this aspect, the present invention provides a method for inhibiting metastasis (e.g., bone metastasis, lung metastasis, liver metastasis, spleen metastasis, lymph node metastasis, or brain metastasis) of cancer cells, particularly, for inhibiting bone metastasis or lung metastasis of cancer cells, comprising the step of administering an effective amount of the anti-FSTL1 antibody of the present invention or the fragment or functional equivalent thereof to a test subject in need thereof. Particularly, it has heretofore been considered that bone metastasis is very difficult to inhibit. Nonetheless, it has been found that this can be remarkably inhibited, as shown herein in Examples. In this respect as well, the superiority of the present invention is found. It is understood that an antibody of an arbitrary embodiment or arbitrary example described herein in the section (Anti-FSTL1 antibody), etc. can be used as the antibody or the fragment or functional equivalent thereof usable in the method of the present invention.

In a further alternative aspect, the present invention provides an inhibitor of induction or enhancement of immune defect such as immunosuppression or immunodeficiency by mesenchymal stem cells (MSCs), comprising the anti-FSTL1 antibody of the present invention or the fragment or functional equivalent thereof. The enhancement of immune defect such as immunosuppression or immunodeficiency includes at least one of growth of MSC cells having immunosuppressive activity or immunodeficient activity, enhancement of the immunosuppressive activity or immunodeficient activity of MSC cells having immunosuppressive activity or immunodeficient activity, and acquierment of immunosuppressive activity or immunodeficient activity by cells lacking immunosuppressive activity or immunodeficient activity. The enhancement of immune defect such as immunosuppression or immunodeficiency by mesenchymal stem cells (MSCs) also conceptually encompasses induction of mesenchymal stem cells inducing immune defect such as immunosuppression or immunodeficiency. Such MSCs having high immunosuppressive ability are also known as activated MSCs or cancer-associated MSCs. Although not wishing to be bound by any theory, FSTL1 secreted from Snail-positive cancer cells or the like acts on so-called progenitor cells of MSCs so that the MSCs secrete an agent causing differentiation of progenitor cells of immunosuppressive cells into immunosuppressive immune-related cells (e.g., regulatory T cells, regulatory dendritic cells, tolerogenic dendritic cells, and myeloid-derived suppressor cells) and/or an agent promoting growth thereof, and/or an agent enhancing their immunosuppressive activity. As a result, the so-called progenitor cells become immunosuppressive cells, probably leading to an immunosuppressed state. Accordingly, the action of the anti-FSTL1 antibody as described in the invention of the present application probably suppresses the action of FSTL1 and consequently mitigate an immunosuppressed state.

Thus, in an alternative aspect, the present invention provides an inhibitor of acquirement and/or enhancement of activity of immune defect such as immunosuppression or immunodeficiency by or of immune-related cells, comprising the anti-FSTL1 antibody of the present invention or the fragment or functional equivalent thereof. The acquierment and/or enhancement of activity of immune defect such as immunosuppression or immunodeficiency by or of immune-related cells also includes the event of induction of immunosuppressive cells. Therefore, the inhibitor of acquirement and/or enhancement of activity of immune defect such as immunosuppression or immunodeficiency by or of immune-related cells conceptually includes an inhibitor of induction of cells having the activity of immune defect such as immunosuppression or immunodeficiency. It is understood that an antibody of an arbitrary embodiment or arbitrary example described herein in the section (Anti-FSTL1 antibody), etc. can be used as the antibody or the fragment or functional equivalent thereof usable in the method of the present invention.

In this aspect, the present invention provides the anti-FSTL1 antibody of the present invention or the fragment or functional equivalent thereof for the inhibition of acquierment and/or enhancement of activity of immune defect such as immunosuppression or immunodeficiency by or of immune-related cells. It is understood that an antibody of an arbitrary embodiment or arbitrary example described herein in the section (Anti-FSTL1 antibody), etc. can be used as the antibody or the fragment or functional equivalent thereof for the inhibition of acquirement and/or enhancement of activity of immune defect such as immunosuppression or immunodeficiency by or of immune-related cells according to the present invention.

In this aspect, the present invention provides a method for inhibiting acquirement and/or enhancement of immunosuppressive activity, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In one embodiment, the acquirement and/or enhancement of activity of immune defect such as immunosuppression or immunodeficiency for the inhibitor of the present invention includes at least 1, preferably at least 2, more preferably 3, more preferably 4, more preferably 5, more preferably 6, more preferably 7, more preferably 8, more preferably 9, more preferably 10, more preferably 11, more preferably all selected from the group consisting of growth of regulatory T cells, enhancement of the immunosuppressive activity of regulatory T cells, differentiation into regulatory T cells, enhancement of the immunosuppressive activity of regulatory dendritic cells, growth of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of (expansion of or differentiation into) exhausted T cells.

In a preferred embodiment, the present invention further includes a cell-killing agent in addition to the anti-FSTL1 antibody or the fragment or functional equivalent thereof. Thus, the composition, the agent, the medicament, etc. (therapeutic drug or prophylactic drug, etc.) of the present invention may comprise a complex molecule or may be conjugated therewith.

In one aspect, the combination drug of the present invention may be combined with additional cancer treatment, in addition to a FSTL1 suppressor and a PD-L1 suppressor. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In the present specification, "cell-killing agent" is an agent likely to lyse cell membranes. In the case of a peptide, the cell-killing agent is called cytotoxic peptide. The cytotoxic peptide has various names in the art and is also referred to as, for example, "lytic peptide component", "cell-killing sequence", "cytolytic peptide (sequence)", or "cell membrane lytic peptide (sequence)". These terms are used interchangeably for the purpose of the present invention. Typical examples of such a cytotoxic agent can include those listed in Gail D. et al., Cancer Res 2008; 68: 9280-9290; Ian Krop and Eric P. Winer, Clin Cancer Res; 20 (1); 1-6; and K Naito et al., Leukemia (2000) 14, 1436-144, and can include maytansinoid, emtansine, and N-acetyl-γ-calicheamicin dimethylhydrazide (NAc-γ-calicheamicin, DMH) contained in CMA-676, though the cytotoxic agent is not limited thereto. As for the peptide, typical examples of the cell-killing peptide can include, but are not limited to, cell membrane lytic peptides, cell membrane potential-destabilizing peptides, cell membrane lytic/nucleic acid-binding peptides, and mitochondrial membrane-disrupting peptides.

If necessary, such a cell-killing agent may be bound to the binding agent (antibody, etc.) of the present invention via a spacer. In the present specification, "spacer" refers to a moiety that forms a chemical bond between chain polymer molecules so as to bridge the molecules, and is also called linker. Typical examples of the peptide spacer include, but are not limited to, a sequence of 0 to 5 amino acids consisting of G or P. The spacer is not essential and may be absent.

In the present invention, the combination of the anti-FSTL1 antibody and/or the antibody PD-L1 antibody, or fragment(s) or functional equivalent(s) thereof, and the cell-killing agent may be provided as a complex molecule. For exemplary explanation of such a molecule, the molecule can be interpreted as being formed by a cytotoxic moiety which corresponds to an explosive moiety and a moiety in charge of specificity for cancer cells which corresponds to a warhead moiety (e.g., a peptide or a sequence, typically an antibody, specifically binding to a receptor highly expressed in cancer cells) in combination. In the case of using a spacer, the complex molecule is constituted by cancer cell-specific binding agent+spacer+ cell-killing agent. In the present specification, an arbitrary cancer cell-specific binding agent, an arbitrary spacer, and an arbitrary cell-killing agent can be arbitrarily combined, and exemplary production and use methods thereof are described. Such a molecule may be produced usually by a chemical synthesis method or, when constituted by peptides, by a method of forcedly expressing the molecule by gene recombination, followed by purification, or a combined method thereof.

As for the use of the present invention, the expression of FSTL1 on the surface of cancer cells to be treated and the damage sensitivity of the cancer cells for the cell-killing agent are examined. On the basis of the results, the warhead and the explosive are selected, and a molecule optimal for the cancer cells is designed. The treatment can be performed by combining a custom-made peptide toxin obtained by chemical synthesis or the like, if necessary, with DDS containing atelocollagen or the like, followed by local administration or systemic administration.

The present invention has been found from working effects on Snail-positive cancer cells. Therefore, although not wishing to be bound by any theory, the target of the present invention can include cancer caused by Snail-positive cancer cells. Since some cancer cells cause EMT and express SNAIL, cells with "EMT" reportedly express SNAIL not only in such limited and several types of cancers but in really various cancer types. Examples of such cancer can include, but are not limited to, squamous cell cancer, melanoma, colorectal cancer, breast cancer, lymphoma, lung cancer, prostate cancer, kidney cancer, thyroid gland cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma.

An administration route effective for treatment is preferably used for the therapeutic drug and may be, for example, intravenous, subcutaneous, intramuscular, intraperitoneal, or oral administration. The dosage form may be, for example, an injection, a capsule, a tablet, or granules. In the case of administering the antibody or the polynucleotide, use as an injection is effective. An injectable aqueous solution may be preserved in, for example, a vial or a stainless container. Also, the injectable aqueous solution may be supplemented with, for example, saline, sugar (e.g., trehalose), NaCl, or NaOH. The therapeutic drug may be supplemented with, for example, a buffer (e.g., a phosphate buffer solution), a stabilizer, or a sustained-release agent such as an adjuvant.

In general, the composition, the medicament, the agent (therapeutic agent, prophylactic agent, etc.), etc. of the present invention comprises a therapeutically effective amount of the therapeutic agent or active ingredient, and a pharmaceutically acceptable carrier or excipient. In the present specification, the phrase "pharmaceutically acceptable" means that for use in animals, more specifically, humans, the material has been approved by government's regulatory authorities or is pharmacopeial or is listed in other generally accepted pharmacopoeia. "Carrier" used herein refers to a diluent, an adjuvant, an excipient, or a vehicle that is administered together with the therapeutic agent. Such a carrier may be a sterile liquid, for example, water or oil. The carrier includes those of petroleum, animal, plant, or synthetic origin and includes, but is not limited to, peanut oil, soybean oil, mineral oil, and sesame oil. In the case of orally administering the medicament, water is a preferred carrier. In the case of intravenously administering the pharmaceutical composition, saline or aqueous dextrose is a preferred carrier. Preferably, a saline solution or an aqueous dextrose or glycerol solution is used as a liquid carrier for an injectable solution. An appropriate excipient includes light anhydrous silicic acid, crystalline cellulose, mannitol, starch, glucose, lactose, sucrose, gelatin, malt, rice, wheat flour, chalk, silica gel, sodium stearate, glycerol monostearate, talc, sodium chloride, powdered skim milk, glycerol, propylene, glycol, water, ethanol, carmellose calcium, carmellose sodium, hydroxypropylcellulose, hydroxypropylmethylcellulose, polyvinyl acetal diethylaminoacetate, polyvinylpyrrolidone, gelatin, medium-chain fatty acid triglyceride, polyoxyethylene hydrogenated castor oil 60, saccharose, carboxymethylcellulose, corn starch, inorganic salts, and the like. If desired, the composition may also contain a small amount of a wetting agent or emulsifying agent, or a pH buffering agent. Such a composition may assume the form of a solution, a suspension, an emulsion, a tablet, a pill, a capsule, a powder, a sustained-release formulation, or the like. The composition may be formulated as a suppository using a traditional binder and carrier, for example, triglyceride. An oral formulation may contain a standard carrier such as a pharmaceutical grade of mannitol, lactose, starch, magnesium stearate, saccharin sodium, cellulose, or magnesium carbonate. Examples of an appropriate carrier are described in E. W. Martin, Remington's Pharmaceutical Sciences (Mark Publishing Company, Easton, U.S.A). Such a composition contains a therapeutically effective amount of a therapeutic agent, preferably a purified form, together with an appropriate amount of the carrier, so as to provide a dosage form appropriate for a patient. The formulation must be suitable for the mode of administration. In addition, for example, a surfactant, an excipient, a colorant, a flavor, a preservative, a stabilizer, a buffer, a suspending agent, a tonicity agent, a binder, a disintegrant, a lubricant, a flowability-promoting agent, and a corrigent may be contained therein.

In the case of administering the medicament of the present invention, various delivery systems are known, and the therapeutic agent of the present invention may be administered to an appropriate site (e.g., the esophagus) using such a system. Such a system includes, for example: encapsulation in liposomes, microparticles, and microcapsules; use of recombinant cells capable of expressing the therapeutic agent (e.g., polypeptide); and use of endocytosis mediated by a receptor. An introduction method is not limited and includes, intracutaneous, intramuscular, intraperitoneal, intravenous, subcutaneous, intranasal, epidural, and oral routes. The medicament may be administered through any suitable route, for example, by injection, by bolus injection, or by absorption through epithelial or mucocutaneous linings (e.g., the mouth, the rectus, and intestinal mucosa). If necessary, an inhalator or an atomizer may be used by use of an aerosol agent. Furthermore, the medicament may be administered together with another biologically active agent. The administration may be systemic or local. The present invention also permits direct administration to tumor.

In a preferred embodiment, the composition can be formulated as a pharmaceutical composition adapted to administration to humans according to a publicly known method. Such a composition can be administered by injection. Typically, the composition for administration by injection is a solution in a sterile isotonic aqueous buffer. If necessary, the composition may also contain a solubilizing agent and a local anesthetic, such as lidocaine, which lessens pain at an injection site. In general, ingredients are separately supplied or mixed and supplied together in a unit dosage form, and can be supplied, for example, as a freeze-dried powder or a water-free concentrate in a sealed container, such as an ampule or a sachet, which indicates the amount of the active agent. In the case of administering the composition by injection, the composition may be dispensed using injection bottles containing a sterile drug grade of water or saline. In the case of administering the composition by injection, an ampule with sterile water or saline for injection may be provided such that ingredients can be mixed before the administration.

The antibody, etc. the composition, the medicament, the agent (therapeutic agent, prophylactic agent, etc.), etc. of the present invention may be formulated in a neutral or salt form or as any other prodrug (e.g., ester). A pharmaceutically acceptable salt includes a salt formed with a free carboxyl group derived from hydrochloric acid, phosphoric acid, acetic acid, oxalic acid, tartaric acid, or the like, a salt formed with a free amine group derived from isopropylamine, triethylamine, 2-ethylaminoethanol, histidine, procaine, or the like, and a salt derived from sodium, potassium, ammonium, calcium, ferric hydroxide, or the like.

The amount of the therapeutic agent of the present invention effective for the treatment of a particular disorder or condition may vary depending on the properties of the disorder or the condition and can be determined by those skilled in the art according to a standard clinical technique on the basis of the description of the present specification. In some cases, use of in vitro assay may assist in the identification of the optimum dosage range. An accurate dose to be used in a formulation may also vary depending on an administration route and the severity of a disease or a disorder and should therefore be determined according to the judgment of a doctor in attendance and the situation of each patient. However, the dose may be, but is not particularly limited to, for example, 0.001, 1, 5, 10, 15, 100, or 1000 mg/kg body weight in one dose, or may be within the range of any two of these values. The dosing interval may be, but is not particularly limited to, for example, once or twice per 1, 7, 14, 21, or 28 days, or may be once or twice per the range of any two of these values. The dose, the dosing interval, and the administration method may be appropriately selected according to the age and body weight of a patient, symptoms, a target organ, etc. The therapeutic drug preferably comprises the active ingredient in a therapeutically effective amount, or an effective amount that exerts the desired action. In the case where a malignant tumor marker is significantly reduced after administration, the therapeutic drug may be judged as having therapeutic effects. The effective dose is predictable from a dose-response curve obtained from an in vitro or animal model test system.

In one embodiment of the present invention, "patient" includes a human or a non-human mammal (e.g., one or more of a mouse, a guinea pig, a hamster, a rat, a rodent, a rabbit, a pig, sheep, a goat, cattle, a horse, a cat, a dog, a marmoset, a monkey, a chimpanzee, and the like). Also, the patient may be a patient judged or diagnosed as having FSTL1- or Snail-positive malignant tumor. In this respect, it is preferred to conduct the judgment or diagnosis by detecting the protein level of FSTL1 or Snail.

The pharmaceutical composition or the agent (therapeutic agent, prophylactic agent, etc.) of the present invention can be provided as a kit. In a particular embodiment, the present invention provides a drug pack or kit comprising one or more containers packed with one or more ingredients of the composition or the medicament of the present invention. In some cases, information indicating governmental agency's approval for production, use, or distribution for administration to humans in a form specified by the governmental agency that regulates the production, use, or distribution of medicaments or biological products may be shown with such containers.

The kit of the present invention may also contain an expression vector encoding a protein that is used as the antibody, etc., the composition, the therapeutic agent, the prophylactic agent, or the medicament of the present invention. This protein forms a biologically active complex after being expressed, and may therefore be reconstituted. Such a kit also preferably contains a necessary buffer and reagent. In some cases, an instruction manual (package insert) for use of the kit, and/or information indicating governmental agency's approval for production, use, or distribution for administration to humans in a form specified by the governmental agency that regulates the production, use, or distribution of medicaments or biological products may be shown with such containers.

(Combination Drug)

In one aspect, the present invention provides a combination product of a FSTL1 suppressor and a PD-L1 suppressor. Although not wishing to be bound by any theory, the present invention is based on the unexpectedly remarkable enhancement of an immunosuppression-mitigating effect on cancer as illustrated in Examples showing such a remarkable effect that subcutaneous tumor disappeared in bone metastasis models by suppressing the pathway of FSTL1 and also suppressing the pathway of PD-L1. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted. The FSTL1 suppressor and the PD-L1 suppressor that can be used in the present invention may be in any form including those listed above, etc. as long as these suppressors can suppress the signaling pathway of FSTL1 and the signaling pathway of PD-L1, respectively. In a preferred embodiment, in the combination product of the present invention, the FSTL1 suppressor is an anti-FSTL1 antibody or a fragment or functional equivalent thereof, and/or the PD-L1 suppressor is an anti-PD-L1 antibody or a fragment or functional equivalent thereof. In one aspect, the present invention provides a combination product of an anti-FSTL1 antibody or a fragment or functional equivalent thereof and an anti-PD-L1 antibody or a fragment or functional equivalent thereof.

This combination product unexpectedly exhibited effects on cancer, as demonstrated in Examples. Specifically, three antibody drugs for mitigation of immunosuppression were each administered at the same time with the anti-FSTL1 antibody to bone metastasis models. As a result, only in the case of combined use with the anti-PD-L1 antibody, the antitumor effect of the anti-FSTL1 antibody was enhanced and showed such a remarkable effect that subcutaneous tumor disappeared in two out of the five mice. In the combined use with the anti-CTLA4 antibody or the anti-PD1 antibody, no synergistic effect was confirmed. Rather, the drug efficacy of the anti-FSTL1 antibody was canceled, and neither bone metastasis nor MSC expansion was able to be strongly suppressed. At least in bone metastasis models, the tendency that these antibodies enhanced bone metastasis was observed. Therefore, this effect is specific for PD-L1, but is not a combined effect found in every antibody mitigating immunosuppression.

In one embodiment, the anti-FSTL1 antibody used in the present invention recognizes an epitope in a region selected from the group consisting of amino acid positions 48 to 100, 148 to 170 (preferably 148 to 162), 193 to 228 or 193 to 216, 205 to 228, and 272 to 289 of SEQ ID NO: 250 (amino acid sequence of human FSTL1).

In a preferred embodiment, the anti-FSTL1 antibody used in the present invention comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303;

heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317).

In a more preferred embodiment, the anti-FSTL1 antibody used in the present invention comprises the full-length variable regions of an antibody selected from the group consisting of antibody #6-55 (light chain: SEQ ID NO: 275; heavy chain: SEQ ID NO: 277), #7-34 (light chain: SEQ ID NO: 279; heavy chain: SEQ ID NO: 281), #8-1 (light chain: SEQ ID NO: 283; heavy chain: SEQ ID NO: 285), #7 (light chain: SEQ ID NO: 299; heavy chain: SEQ ID NO: 301), #10 (light chain: SEQ ID NO: 303; heavy chain: SEQ ID NO: 305), #13 (light chain: SEQ ID NO: 307; heavy chain: SEQ ID NO: 309) and #33 (light chain: SEQ ID NO: 315; heavy chain: SEQ ID NO: 317).

In a further alternative embodiment, the anti-FSTL1 antibody used in the present invention comprises a full-length antibody selected from the group consisting of antibody #6-55 (light chain: SEQ ID NO: 365; heavy chain: SEQ ID NO: 367), #7-34 (light chain: SEQ ID NO: 369; heavy chain: SEQ ID NO: 371), #8-1 (light chain: SEQ ID NO: 373; heavy chain: SEQ ID NO: 375), #7 (light chain: SEQ ID NO: 389; heavy chain: SEQ ID NO: 391), #10 (light chain: SEQ ID NO: 303; heavy chain: SEQ ID NO: 305), #13 (light chain: SEQ ID NO: 397; heavy chain: SEQ ID NO: 399) and #33 (light chain: SEQ ID NO: 405; heavy chain: SEQ ID NO: 407) or a humanized sequence thereof.

In one embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 418, 420, 422, and 424, respectively) and L chain FR1, FR2, FR3, and FR4 (SEQ ID NOs: 434, 436, 438, and 440, respectively) of H(2)-L(1).

In one embodiment, the anti-PD-L1 antibody used in the present invention recognizes an epitope similar to an epitope for clone MIH5 or clone 10F.9G2. These epitopes are interpreted as PD-L1-CD80 binding regions. See J Immunol. 2013 Sep. 1; 191 (5): 2829-2836 (http://www.ncbi.nlm.nih.gov/pmc/articles/PMC3750086/) and J Immunol. 2011 Aug. 1; 187 (3): 1097-1105 (http://www.ncbi.nlm.nih.gov/pmc/articles/PMC3148082/). It is understood that any antibody capable of competing, for example, in a competitive inhibition method described in these literatures can be an alternative antibody of the present invention.

In an alternative embodiment, the anti-PD-L1 antibody used in the present invention has the ability to inhibit the binding between PD-L1 and PD-1. The ability to inhibit the binding between PD-L1 and PD-1 can be measured by a method found in, for example, Alison M. Paterson, et al., The Journal of Immunology, 2011, 187: 1097-1105.

In an alternative embodiment, the anti-PD-L1 antibody used in the present invention comprises the heavy chain CDR1, heavy chain CDR2, heavy chain CDR3, light chain CDR1, light chain CDR2, and light chain CDR3 of (antibody clone MIH5 or clone 10F.9G2.

In an alternative embodiment, the anti-PD-L1 antibody used in the present invention comprises the full-length variable regions of antibody clone MIH5 or clone 10F.9G2.

In an alternative embodiment, the anti-PD-L1 antibody used in the present invention comprises full-length antibody clone MIH5 or clone 10F.9G2 or a humanized sequence thereof.

In an alternative aspect, the present invention provides a medicament comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the medicament of the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides an anticancer agent comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides a therapeutic agent for metastatic malignant tumor comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for metastatic malignant tumor of the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides a therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for these diseases of the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides an inhibitor of metastasis (e.g., bone metastasis or lung metastasis) of cancer cells, comprising the combination product of the present invention and provides an inhibitor capable of inhibiting even bone metastasis, lung metastasis, liver metastasis, spleen metastasis, lymph node metastasis, or brain metastasis, particularly, bone metastasis or lung metastasis. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of metastasis of cancer cells of the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides an inhibitor of induction or enhancement of immune defect such as immunosuppression or immunodeficiency by mesenchymal stem cells (MSCs), comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of induction or enhancement of immune defect such as immunosuppression or immunodeficiency by MSCs according to the present invention. It is understood that an antibody of an arbitrary embodiment or arbitrary example described herein can be used as the anti-PD-L1 antibody or the fragment or functional equivalent thereof in the medicament of the present invention.

In a further alternative aspect, the present invention provides an inhibitor of acquirement and/or enhancement of activity of immune defect such as immunosuppression or immunodeficiency by or of immune-related cells, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of acquirement and/or enhancement of activity of immune defect such as immunosuppression or immunodeficiency by or of immune-related cells according to the present invention. It is understood that an antibody of an arbitrary embodiment or arbitrary example described herein can be used as the anti-PD-L1 antibody or the fragment or functional equivalent thereof in the medicament of the present invention.

In one embodiment, the acquirement and/or enhancement of immune defect activity by or of immune-related cells includes at least 1, preferably at least 2, more preferably at least 3, more preferably at least 4, more preferably at least 5, more preferably at least 6, more preferably at least 7, more preferably at least 8, more preferably at least 9, more preferably at least 10, more preferably at least 11, more preferably at least 12, more preferably at least 13, more preferably at least 14, more preferably all selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

In one aspect, the medicament, the anticancer agent, the therapeutic agent, or the inhibitor of the present invention may be combined with additional cancer treatment. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In an alternative aspect, the present invention provides an anticancer agent comprising a FSTL1 suppressor, wherein the FSTL1 suppressor is administered in combination with a PD-L1 suppressor. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. The FSTL1 suppressor and the PD-L1 suppressor that can be used in the present invention may be in any form including those listed above, etc. as long as these suppressors can suppress the signaling pathway of FSTL1 and the signaling pathway of PD-L1, respectively. In a preferred embodiment, in the anticancer agent of the present invention, the FSTL1 suppressor is an anti-FSTL1 antibody or a fragment or functional equivalent thereof, and/or the PD-L1 suppressor is an anti-PD-L1 antibody or a fragment or functional equivalent thereof.

Preferably, the present invention provides an anticancer agent comprising an anti-FSTL1 antibody or a fragment or functional equivalent thereof, wherein the anti-FSTL1 antibody or the fragment or functional equivalent thereof is administered in combination with an anti-PD-L1 antibody or a fragment or functional equivalent thereof. The type of usage of such an anticancer agent, which comprises the anti-FSTL1 antibody or the fragment or functional equivalent thereof, is combined use, and such combined use is described, for example, in a kit or in a package insert. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the anti-FSTL1 antibody or the fragment or functional equivalent thereof. It is understood that an antibody of an arbitrary embodiment or arbitrary example described herein can be used as the anti-PD-L1 antibody or the fragment or functional equivalent thereof in the medicament of the present invention.

In an alternative aspect, the present invention provides an anticancer agent comprising a PD-L1 suppressor, wherein the PD-L1 suppressor is administered in combination with a FSTL suppressor. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. The FSTL1 suppressor and the PD-L1 suppressor that can be used in the present invention may be in any form including those listed above, etc. as long as these suppressors can suppress the signaling pathway of FSTL1 and the signaling pathway of PD-L1, respectively. In a preferred embodiment, in the anticancer agent of the present invention, the FSTL1 suppressor is an anti-FSTL1 antibody or a fragment or functional equivalent thereof, and/or the PD-L1 suppressor is an anti-PD-L1 antibody or a fragment or functional equivalent thereof.

Preferably, the present invention provides an anticancer agent comprising an anti-PD-L1 antibody or a fragment or functional equivalent thereof, wherein the anti-PD-L1 antibody or the fragment or functional equivalent thereof is administered in combination with an anti-FSTL1 antibody or a fragment or functional equivalent thereof. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the anti-PD-L1 antibody or the fragment or functional equivalent thereof. It is understood that an antibody of an arbitrary embodiment or arbitrary example described herein can be used as the anti-PD-L1 antibody or the fragment or functional equivalent thereof in the medicament of the present invention.

In one aspect, the present invention provides a method for treating or preventing cancer, comprising the step of administering an effective amount of a FSTL1 suppressor and an effective amount of a PD-L1 suppressor in combination. Although not wishing to be bound by any theory, the method of the present invention is based on the unexpectedly remarkable enhancement of an immunosuppression-mitigating effect on cancer as illustrated in Examples showing such a remarkable effect that subcutaneous tumor disappeared by suppressing the pathway of FSTL1 and also suppressing the pathway of PD-L1. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted. The FSTL1 suppressor and the PD-L1 suppressor that can be used in the present invention may be in any form including those listed above, etc. as long as these suppressors can suppress the signaling pathway of FSTL1 and the signaling pathway of PD-L1, respectively. In a preferred embodiment, in the method of the present invention, the FSTL1 suppressor is an anti-FSTL1 antibody or a fragment or functional equivalent thereof, and/or the PD-L1 suppressor is an anti-PD-L1 antibody or a fragment or functional equivalent thereof.

Preferably, the present invention provides a method for treating or preventing cancer, comprising the step of administering an effective amount of an anti-FSTL1 antibody or a fragment or functional equivalent thereof and an effective amount of an anti-PD-L1 antibody or a fragment or functional equivalent thereof in combination to a test subject in need thereof. The anti-FSTL1 antibody or the fragment or functional equivalent thereof and the anti-PD-L1 antibody or the fragment or functional equivalent thereof may be administered at the same time or may be administered separately (at different times). The anti-FSTL1 antibody or the fragment or functional equivalent thereof and the anti-PD-L1 antibody or the fragment or functional equivalent thereof may be prepared as a combination formulation or may be administered as separate dosage forms. The anti-FSTL1 antibody or the fragment or functional equivalent thereof and the anti-PD-L1 antibody or the fragment or functional equivalent thereof may be administered through the same route or may be administered through different routes (e.g., oral and intravenous routes).

(General Technique)

Molecular biological approaches, biochemical approaches, and microbial approaches used herein are well known in the art and conventionally used. These approaches are described in, for example, Sambrook J. et al. (1989). Molecular Cloning: A Laboratory Manual, Cold Spring Harbor and Id., 3rd Ed. (2001); Ausubel, F. M. (1987). Current Protocols in Molecular Biology, Greene Pub. Associates and Wiley-Interscience; Ausubel, F. M. (1989). Short Protocols in Molecular Biology: A Compendium of Methods from Current Protocols in Molecular Biology, Greene Pub. Associates and Wiley-Interscience; Innis, M. A. (1990). PCR Protocols: A Guide to Methods and Applications, Academic Press; Ausubel, F. M. (1992). Short Protocols in Molecular Biology: A Compendium of Methods from Current Protocols in Molecular Biology, Greene Pub. Associates; Ausubel, F. M. (1995). Short Protocols in Molecular Biology: A Compendium of Methods from Current Protocols in Molecular Biology, Greene Pub. Associates; Innis, M. A. et al. (1995). PCR Strategies, Academic Press; Ausubel, F. M. (1999). Short Protocols in Molecular Biology: A Compendium of Methods from Current Protocols in Molecular Biology, Wiley, and annual updates; Sninsky, J. J. et al. (1999). PCR Applications: Protocols for Functional Genomics, Academic Press, and Experimental Medicine, Suppl. "Experimental Methods for Gene Transfer & Expression Analysis", Yodosha Co., Ltd., 1997, the related parts (which may be the entire parts) of which are incorporated herein by reference.

DNA synthesis techniques and nucleic acid chemistry for preparing artificially synthesized genes are described in, for example, Gait, M. J. (1985). Oligonucleotide Synthesis: A Practical Approach, IRL Press; Gait, M. J. (1990). Oligonucleotide Synthesis: A Practical Approach, IRL Press; Eckstein, F. (1991). Oligonucleotides and Analogues: A Practical Approach, IRL Press; Adams, R. L. et al. (1992). The Biochemistry of the Nucleic Acids, Chapman & Hall;

Shabarova, Z. et al. (1994). Advanced Organic Chemistry of Nucleic Acids, Weinheim; Blackburn, G. M. et al. (1996). Nucleic Acids in Chemistry and Biology, Oxford University Press; Hermanson, G. T. (1996). Bioconjugate Techniques, Academic Press, the related parts of which are incorporated herein by reference.

In the present specification, the oligonucleotide of the present invention may be synthesized, for example, by a standard method known in the art using, for example, an automatic DNA synthesis apparatus (e.g., commercially available from Biosearch Technologies, Inc., Applied Biosystems, Inc., etc.). For example, phosphorothioate oligonucleotide may be synthesized by the method of Stein et al. (Stein et al., 1988, Nucl. Acids Res. 16: 3209), and methylphosphonate oligonucleotide may be prepared by use of a controlled pore glass polymer support (Sarin et al., 1988, Proc. Natl. Acad. Sci. USA 85: 7448-7451) or the like.

In the present specification, the term "or" is used when "at least one or more" of the items listed in a sentence can be adopted. In the present specification, the phrase "within the range of two values" means that the range also includes the two values themselves.

References such as scientific literatures, patents, and patent applications cited herein are incorporated herein by reference in their entirety to the same extent as respectively described specifically.

The present invention is described above by showing preferred embodiments in order to facilitate understanding. Hereinafter, the present invention will be described with reference to Examples. However, the description mentioned above and Examples given below are provided merely for illustrative purposes and are not intended to limit the present invention. Thus, the scope of the present invention is limited by neither the embodiments nor Examples specifically described herein and is limited only by claims.

EXAMPLES

Hereinafter, the present invention will be further described with reference to Examples. However, the present invention is not intended to be limited by these examples.

<Example 1> Preparation of Anti-FSTL1 Antibody

Three 3-month-old Boris Brown chickens were intraperitoneally immunized with 100 μg of an antigen human FSTL1 (Novoprotein, Cat # CF23) (SEQ ID NO: 408) per shot per chicken. A complete Freund's adjuvant (Wako Pure Chemical Industries, Ltd., 014-09541) for primary immunization and an incomplete Freund's adjuvant (Wako Pure Chemical Industries, Ltd., 011-09551) for secondary, tertiary, and quaternary immunization were used in the intraperitoneal immunization with the antigen. For quinary immunization, the antigen diluted with PBS (phosphate buffered saline) was intravenously injected thereto. Blood was collected from the veins under the wings every other week, and antibody titers were confirmed by ELISA. The quaternary immunization was carried out for the three chickens, and one individual found to have the largest rise in antibody titer was subjected to quinary immunization, which was used as final immunization. Three days after final immunization, the spleen of the chicken was recovered, and lymphocytes were isolated by density gradient centrifugation using Ficoll paque PLUS (GE Healthcare Japan Corp., 17-1440-03), followed by RNA extraction using TRIzole Reagent (Life Technologies Corp., 15596026). cDNA was synthesized from the extracted RNA by RT-PCR using PrimeScript II 1st Strand cDNA Synthesis Kit (Takara Bio Inc., 6210A), and scFv phage libraries were prepared. The expression vector used was pPDS. The preparation of the scFv phage libraries was performed by the method described in the reference "Nakamura et al., J Vet Med Sci. 2004 Ju; 66 (7): 807-814".

FSTL1-specific phages were enriched by panning using the scFv phage libraries. The antigen used in the panning was human FSTL1 (Novoprotein, Cat # CF23) alone or two antigens for panning, human FSTL1 (R&D Systems, Inc., Cat #1694-FN-050) and mouse FSTL1 (R&D Systems, Inc., Cat #1738-FN-050), alternately used. Antibodies also having cross reactivity with mice were thereby obtained. The panning was performed according to the method described in the reference "Nakamura et al., J Vet Med Sci. 2004 Ju; 66 (7): 807-814". After the 5th round of panning, the reactivity of the libraries was confirmed by ELISA using human FSTL1- and mouse FSTL1-immobilized plates, and phage screening was conducted from a library whose reactivity started to rise. For scFv phage antibody sample preparation, E. coli was infected with a phage and plated over 2×YT Agar plate containing ampicillin (50 μg/ml, Nacalai Tesque, Inc., 02739-32), and the obtained colonies were cultured in a 2×YT liquid medium containing ampicillin. After infection with a helper phage, phage induction was performed in 2×YT liquid medium containing ampicillin (50 μg/ml), kanamycin (25 μg/ml, Meiji Seika Pharma Co., Ltd., GS1-RSS), and IPTG (100 μg/ml, Nacalai Tesque, Inc., 19742-94). The reactivity of scFv phage antibodies in the obtained culture supernatants was confirmed by ELISA using antigen-immobilized plates.

In screening by ELISA, 1 μg/ml of human FSTL1 or mouse FSTL1 diluted with PBS was placed at 50 μl/well to a 96-well plate (Nalge Nunc International, Cat. No. 442404), and the antigen was immobilized overnight at 4° C. After the immobilization, the wells were blocked with PBS containing 25% Block Ace (DS Pharma Biomedical Co., Ltd, UK-B80) and reacted with the culture supernatants containing the scFv phage antibodies. A solution of HRP-labeled Goat anti-mouse IgG (H+L) (Kirkegaard & Perry Laboratories, Inc. (KPL), Cat. No. 474-1806) diluted 1000-fold with 10% Block Ace was added as a secondary antibody, and the color development of OPD used as a substrate was measured as absorbance at 490 nm and 630 nm using a plate leader (Bio-Rad Laboratories, Inc., Model 680). These conditions are summarized in Table 1.

(Table 1 Screening Conditions)

TABLE 2-1

| 1 | Immobilized antigen: | 50 μL/well | O/N, 4° C. | 1 μg/mL human or mouse FSTL1 |
|---|---|---|---|---|
| 2 | Blocking: | 250 μL/well | 60 min, 37° C. | 25% Block Ace/PBS |
| 3 | Primary antibody: | 50 μL/well | 60 min, 37° C. | scFv phage antibody-containing culture supernatant |
| 4 | Secondary antibody: | 50 μL/well | 60 min, 37° C. | HRP-anti-mouse IgG (H + L) in 10% Block Ace/PBS (1:1000) |
| 5 | Chromogenic substrate: | 50 μL/well | 30 min, RT | OPD solution |
| 6 | Reaction termination: | 50 μL/well | | 2N $H_2SO_4$ |
| 7 | Measurement: | | Wavelength 490 nm/630 mn | |

(O/N means overnight.)

The DNA sequencing of the positive clones obtained by ELISA was outsourced to Eurofins Genomics K. K. to determine the sequences.

As for clones differing in sequence, chicken-derived antibody H chain variable region and L chain variable region genes were amplified by PCR with a scFv antibody-encoding DNA strand as a template. Then, the PCR products were digested with restriction enzymes SacII (New England BioLabs Japan Inc., Cat # R0157S) and NheI (New England BioLabs Japan Inc., Cat # R0131S). Next, the H chain variable region and L chain variable region genes were respectively recombined into mouse/chicken chimeric antibody (IgG1) expression vectors (expression vector for H chain: pcDNA4/myc-His, expression vector for L chain: pcDNA3/myc-His, Invitrogen Corp.) treated with the same restriction enzymes as above. CHO cells were transfected with the prepared H chain and L chain constructs. Then, the reactivity of culture supernatants was confirmed by ELISA using a human or mouse FSTL1 protein-immobilized solid phase. The mouse chimeric expression vector used was the vector described in Tateishi et al., J Vet Med Sci. 2008 April; 70 (4): 397-400.

Among the antibody clones (chicken-mouse chimeric antibodies) thus obtained, clone #5-2, #5-3, #5-8, #5-10, #5-43, #6-55, #7-34, #8-1, #8-4, #8-7, #8-8, #6-55, #7, #10, #13, #22, and #33 were used in experiments given below. The amino acid sequences of the light chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 255, 259, 263, 267, 271, 275, 279, 283, 287, 291, 295, 299, 303, 307, 311, and 315, respectively. The full-length amino acid sequences of the light chains thereof are represented by SEQ ID NOs: 345, 349, 353, 357, 361, 365, 369, 373, 377, 381, 385, 389, 393, 397, 401, and 405, respectively. The nucleic acid sequences of the light chain variable regions thereof are represented by SEQ ID NOs: 254, 258, 262, 266, 270, 274, 278, 282, 286, 290, 294, 298, 302, 306, 310, and 314, respectively. The full-length nucleic acid sequences of the light chains thereof are represented by SEQ ID NOs: 344, 348, 352, 356, 360, 364, 368, 372, 376, 380, 384, 388, 392, 396, 400, and 404, respectively. The amino acid sequences of the heavy chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 257, 261, 265, 269, 273, 277, 281, 285, 289, 293, 297, 301, 305, 309, 313, and 317, respectively. The full-length amino acid sequences of the heavy chains thereof are represented by SEQ ID NOs: 347, 351, 355, 359, 363, 367, 371, 375, 379, 383, 387, 391, 395, 399, 403, and 407, respectively. The nucleic acid sequences of the heavy chain variable regions thereof are represented by SEQ ID NOs: 256, 260, 264, 268, 272, 276, 280, 284, 288, 292, 296, 300, 304, 308, 312, and 316, respectively. The full-length nucleic acid sequences of the heavy chains thereof are represented by SEQ ID NOs: 346, 350, 354, 358, 362, 366, 370, 374, 378, 382, 386, 390, 394, 398, 402, and 406, respectively.

For the large-scale production of the antibody clones described above, cultured mammalian cells were transfected with the prepared H chain and L chain constructs using Expi293 Expression system (Invitrogen Corp., Cat # A14635). Then, the expressed antibodies were purified using Protein G Sepharose 4 Fast Flow (GE Healthcare Japan Corp., 17-018-02). The measurement of the binding activity of the obtained purified antibody of each clone against FSTL1 will be shown in Example 2.

<Example 2> Evaluation of Binding Activity of Purified Antibody Against FSTL1

The reactivity of the obtained antibody clones described above with FSTL1 was evaluated by ELISA under the following conditions.
(Table 2 ELISA Conditions for Binding Activity Evaluation of Purified Antibody)
Antibodies used: anti-dinitrophenyl (DNP) antibody (negative control), #5-2, #5-3, #5-8, #5-10, #5-43, #6-55, and #7-34

TABLE 2-2

| 1 | Immobilized antigen: | 50 µL/well | O/N, 4° C. | 5 µg/mL human or mouse FSTL1 |
|---|---|---|---|---|
| 2 | Blocking: | 250 µL/well | 60 min, 37° C. | 25% Block Ace/PBS |
| 3 | Primary antibody: | 50 µL/well | 60 min, 37° C. | Each antibody serially diluted 2-fold from 1 µg/mL/10% Block Ace |
| 4 | Secondary antibody: | 50 µL/well | 60 min, 37° C. | HRP-anti-mouse IgG (H + L) in 10% Block Ace/PBS (1:1000) |
| 5 | Chromogenic substrate: | 50 µL/well | 30 min, RT | OPD solution |
| 6 | Reaction termination: | 50 µL/well | | 2N H$_2$SO$_4$ |
| 7 | Measurement: | | Wavelength 490 nm/630 mn | |

O/N means overnight.

Figure 31:
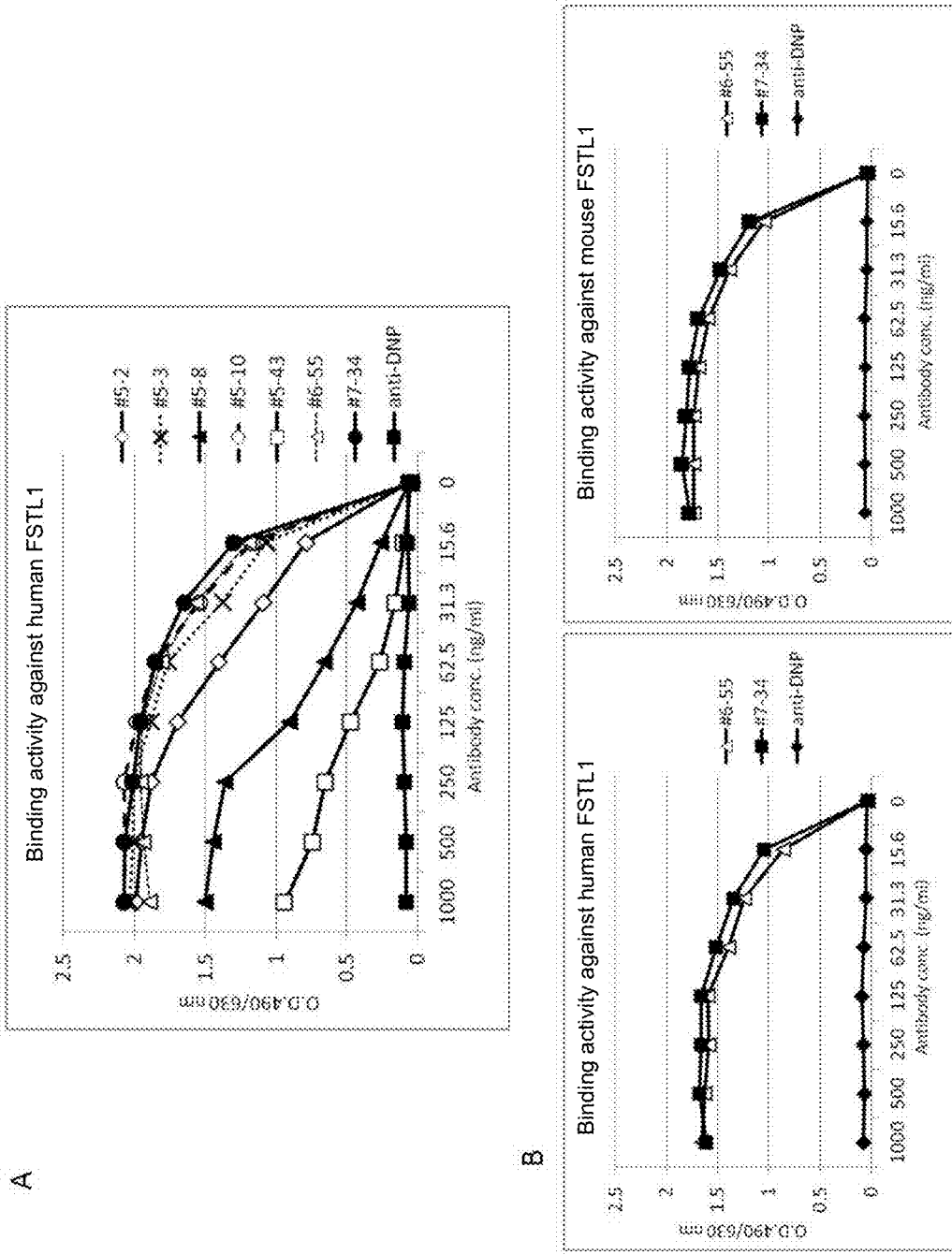
FIG. 31 is graphs showing the binding activity of the antibody of the present invention against FSTL1 (Example 2). Part A shows results of evaluating the binding activity of clones obtained by initial screening against human FSTL1 by ELISA. The open rhomboid depicts clone #5-2, the cross mark depicts clone #5-4, the filled triangle depicts clone #5-8, the open circle depicts clone #5-10, the open square depicts clone #5-43, the open triangle depicts clone #6-55, the filled circle depicts clone #7-34, and the filled square depicts a control anti-dinitrophenyl (DNP) antibody. The strength of the binding activity was #5-10, #6-55, and #7-34>#5-3>#5-8>#5-43. Part B shows results of examining the cross reactivity between mice and humans. Among the antibodies shown in Part A, clones that also exhibited reactivity with mouse FSTL1 in the screening were evaluated for their binding activity. The binding activity against human FSTL1 is shown on the left, and the binding activity against mouse FSTL1 is shown on the right. Both #6-55 and #7-34 exhibited strong binding activity against human and mouse FSTL1.

As a result, binding activity specific for human FSTL1 was confirmed. The strength of the binding activity was compared and was consequently #6-55, #7-34, and #5-10>#5-3>#5-8>#5-43 (FIG. 31A). Among the antibody clones, #6-55 and #7-34 exhibited specific and equivalently strong binding activity against both human and mouse FSTL1 (FIG. 31B).

Figure 32:
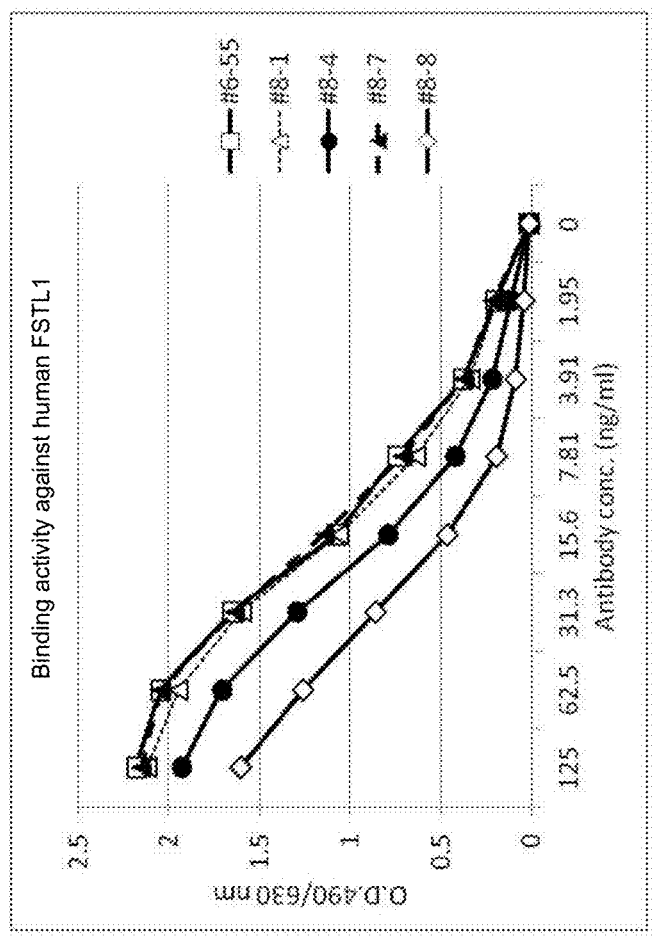
FIG. 32 shows results of evaluating the binding activity of clones obtained by middle screening against human FSTL1 by ELISA (Example 2). The open square depicts clone #6-55, the open triangle depicts clone #8-1, the filled circle depicts clone #8-4, the filled triangle depicts clone #8-7, and the open rhomboid depicts clone #8-8. The assay was conducted together with #6-55 for comparison. The strength of the binding activity was clone #6-55, #8-1, and #8-7>#8-4>#8-8. *The antibody concentration in FIG. 32 was diluted from 125 ng/ml.
Figure 33:
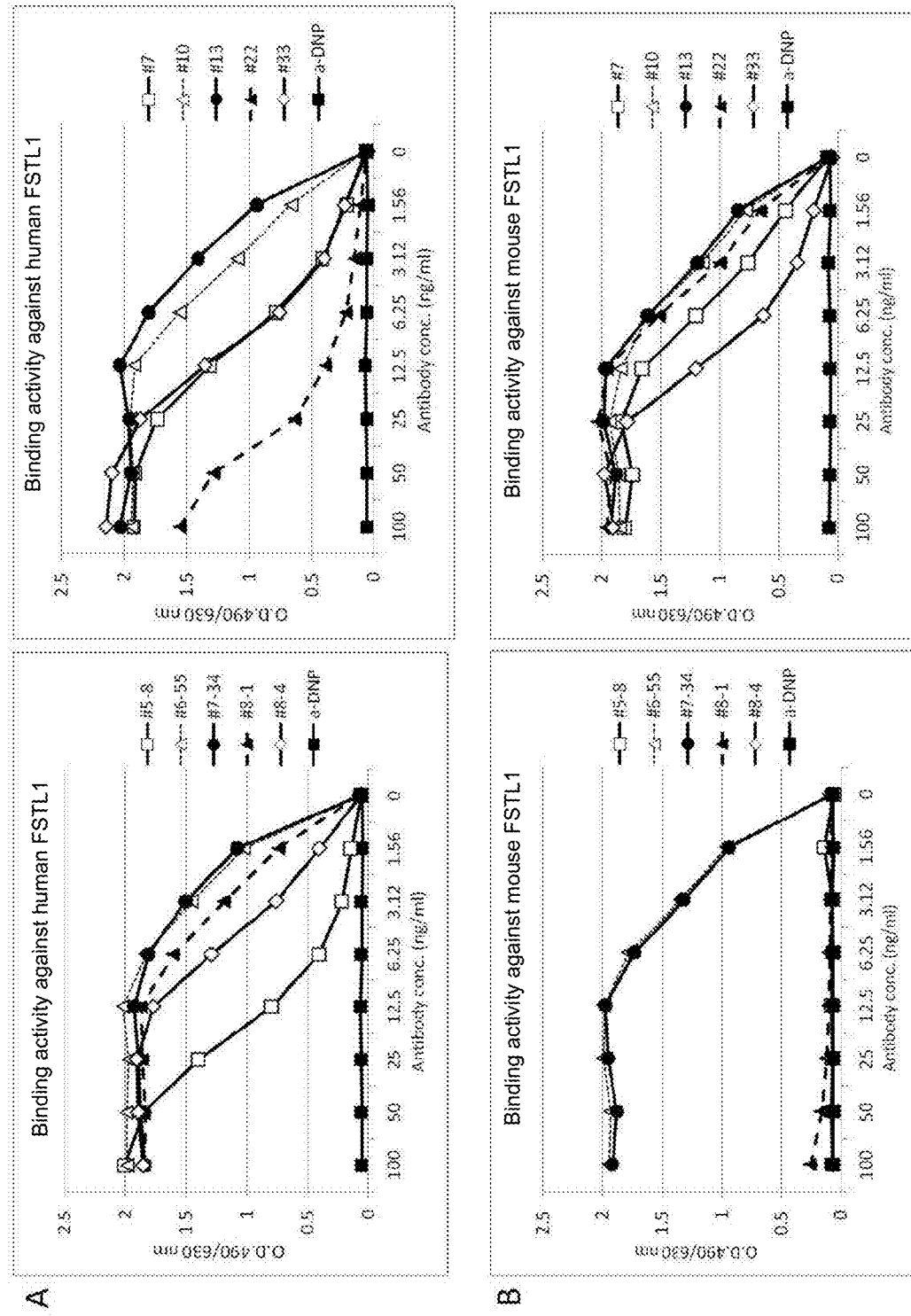
FIG. 33 is graphs showing the binding activity of clones obtained by panning using mouse FSTL1 (Example 2). The right and left graphs of Part A or the right and left graphs of Part B show results that were obtained by evaluation at the same time but were indicated by two divided graphs for the sake of the visibility of the figure due to a large number of clones. Part A shows results of evaluating the binding activity of clones also including clones (#7, #10, #13, #22, and #33) obtained by panning using mouse FSTL1 against human FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against human FSTL1 was #6-55, #7-34, and #13>#8-1 and #10>#8-4>#7 and #33>#5-8>#22. The binding activity of the anti-DNP antibody was not observed. Part B shows results of evaluating the binding activity of the same clones as above against mouse FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against mouse FSTL1 was #6-55, #7-34, #10, and #13>#22>#7>#33>#8-1. #8-1 slightly exhibited binding activity. #5-8, #8-4, and the anti-DNP antibody exhibited no binding activity. The antibody concentration in FIG. 33 was diluted from 100 ng/ml. On the basis of these ELISA results of binding activity and in vitro evaluation, promising clones to be subjected to in vivo evaluation were narrowed down (#6-55, #7-34, and #8-1). Clones newly obtained by panning (#7, #10, #13, #22, and #33) were further used as subjects in the in vivo evaluation.

FIGS. 32 and 33 show results of evaluating binding activity under the condition of Table 3 as to clones differing in screening and antibody purification timings.

(Table 3 ELISA Conditions for Binding Activity Evaluation of Purified Antibody)
Antibodies used: anti-DNP antibody, #5-8, #6-55, #7-34, #8-1, #8-4, #8-7, #8-8, #7, #10, #13, #22, and #33

TABLE 2-3

| 1 | Immobilized antigen: | 50 µL/well | O/N, 4° C. | 5 µg/mL human or mouse FSTL1 |
|---|---|---|---|---|
| 2 | Blocking: | 250 µL/well | 60 min, 37° C. | 25% Block Ace/PBS |
| 3 | Primary antibody: | 50 µL/well | 60 min, 37° C. | Each antibody serially diluted 2-fold from 125 or 100 ng/mL/10% Block Ace |
| 4 | Secondary antibody: | 50 µL/well | 60 min, 37° C. | HRP-anti-mouse IgG (H + L) in 10% Block Ace/PBS (1:1000) |
| 5 | Chromogenic substrate: | 50 µL/well | 30 min, RT | OPD solution |
| 6 | Reaction termination: | 50 µL/well | | 2N H$_2$SO$_4$ |
| 7 | Measurement: | | Wavelength 490 nm/630 mn | |

O/N means overnight.

(Results)

Binding activity specific for human FSTL was confirmed. The strength of the binding activity was compared and was consequently #6-55 and #8-1>#8-7>#8-4>#8-8 (FIG. 32). As a result of further evaluating binding activity against human and mouse FSTL1, the strength of the binding activity against human FSTL1 was #6-55, #7-34, and #13>#8-1 and #10>#8-4>#7 and #33>#5-8>#22 (FIG. 33A). The strength of the binding activity against mouse FSTL1 was #6-55, #7-34, #10, and #13>#22>#7>#33>#8-1, and #8-1 very slightly exhibited binding activity (FIG. 33B). #5-8 and #8-4 exhibited no binding activity against mouse FSTL1.

<Example 3> Epitope Mapping of Antibody

In this Example, the antibodies obtained by preceding Examples were subjected to epitope mapping.
<Gene Synthesis>
For the synthesis of human and mouse FSTL1 genes, the sequences of His-tagged human and mouse FSTL1 genes were designed with reference to sequence information on NM_007085.4 (SEQ ID NO: 250) of the human FSTL1 gene and NM_008047.5 (SEQ ID NO: 252) of the mouse FSTL1 gene such that 3 alanine residues and 10 histidine residues were added to the C terminus. Further, codons were optimized in consideration of expression in mammalian cells. Genes in which nucleic acid sequences for plasmid insertion (SEQ ID NOs: 324 and 325) were respectively added to both ends of each gene were designed, and their synthesis was outsourced to Life Technologies Corp. The nucleic acid and amino acid sequences (SEQ ID NOs: 250, 251, 252, and 253) of the original human and mouse FSTL1 and the nucleic acid sequences of the actually synthesized genes and their amino acid sequences after translation (SEQ ID NOs: 318, 319, 320, and 321) are shown below. Sequence for insertion to plasmids: for N terminus:

```
5'-CGAACCCTTAAGCTTG-3'    (SEQ ID NO: 324)
``` for C terminus:

```
5'-CGTGGCATCTAGACA-3     (SEQ ID NO: 325)
``` human FSTL1 nucleic acid sequence (SEQ ID NO: 250) <In the following sequences, a leader sequence is underlined>

<u>atgtggaaacgctggctcgcgctcgcgctcgcgctggtggcggtcgcctg</u>

<u>ggtccgcgcc</u>gaggaagagctaaggagcaaatccaagatctgtgccaatg tgttttgtggagccggccgggaatgtgcagtcacagagaaaggggaaccc acctgtctctgcattgagcaatgcaaacctcacaagaggcctgtgtgtgg cagtaatggcaagacctacctcaaccactgtgaactgcatcgagatgcct gcctcactggatccaaaatccaggttgattacgatggacactgcaaagag aagaaatccgtaagtccatctgccagcccagttgtttgctatcagtccaa ccgtgatgagctccgacgtcgcatcatccagtggctggaagctgagatca ttccagatggctggttctctaaaggcagcaactacagtgaaatcctagac aagtattttaagaactttgataatggtgattctcgcctggactccagtga attcctgaagtttgtggaacagaatgaaactgccatcaatattacaacgt atccagaccaggagaacaacaagttgcttaggggactctgtgttgatgct ctcattgaactgtctgatgaaaatgctgattggaaactcagcttccaaga gtttctcaagtgcctcaacccatctttcaaccctcctgagaagaagtgtg ccctggaggatgaaacgtatgcagatggagctgagaccgaggtggactgt aaccgctgtgtctgtgcctgtggaaattgggtctgtacagccatgacctg tgacggaaagaatcagaagggggcccagacccagacagaggaggagatga ccagatatgtccaggagctccaaaagcatcaggaaacagctgaaaagacc aagagagtgagcaccaaagagatctaa Mouse FSTL1 nucleic acid sequence (SEQ ID NO: 252)

<u>atgtggaaacgatggctggcgctctcgctggtgaccatcgccctggtcca</u>

<u>cggc</u>gaggaggaacctagaagcaaatccaagatctgcgccaatgtgtttt gtggagctggcagggaatgtgccgtcacagagaaggggagcccacgtgc ctctgcattgagcaatgcaaacctcacaagaggcctgtgtgtggcagtaa tggcaagacctacctcaaccactgtgaacttcatagagatgcctgcctca ctggatccaagatccaggttgattatgatgggcactgcaaagaaaagaag tctgcgagtccatctgccagcccagttgtctgctatcaagctaaccgcga tgagctccgacggcgcctcatccagtggctggaagctgagatcattccag atggctggttctctaaaggcagtaactacagtgagatcctagacaagtac tttaagagctttgataatggcgactctcacctggactccagtgaattcct gaaattcgtggagcagaatgaaacagccatcaacatcaccacttatgcag atcaggagaacaacaaactgctcagaagcctctgtgttgacgccctcatt gaactgtctgatgagaacgctgactggaaactcagcttccaagagttcct caagtgcctcaacccatccttcaaccctcctgagaagaagtgtgccctgg aggacgaaacctatgcagatggagctgagactgaggtggactgcaatcgc tgtgtctgttcctgtggccactgggtctgcacagcaatgacctgtgatgg aaagaatcagaaggggggtccagacccacacagaggaggagaagacaggat atgtccaggaactccagaagcaccagggcacagcagaaaagaccaagaag gtgaacaccaaagagatctaa Nucleic acid sequence of human FSTL1 used in Examples (318)

<u>atgtggaagagatggctggccctggctctggcactggtggctgtggcttg</u>

<u>ggtgcgcgcc</u>gaggaagaactgcggagcaagagcaagatctgcgccaacg tgttctgcggagccggcagagaatgtgccgtgaccgagaagggcgagcct acctgcctgtgcatcgagcagtgcaagccccacaagaggcctgtgtgcgg cagcaacggcaagacctacctgaaccactgcgagctgcaccgggatgcct gtctgaccggcagcaagatccaggtggactacgacggccactgcaaagaa aagaaaagcgtgtccccagcgccagcccgtcgtgttaccagagcaa cagggacgagctgcggcggagaatcatccagtggctggaagccgagatca tccccgacggctggttcagcaagggcagcaactacagcgagatcctggac aagtacttcaagaacttcgacaacggcgacagcagactggacagcagcga -continued
gttcctgaagttcgtggaacagaacgagacagccatcaacatcaccacct accccgaccaggaaaacaacaagctgctgcggggcctgtgcgtggacgcc ctgattgagctgagcgacgagaacgccgactggaagctgagctttcagga atttctgaagtgcctgaaccccagcttcaaccccccgagaagaagtgcg ccctggaggacgagacatacgccgatggcgccgagacagaggtggactgc aacagatgcgtgtgcgcctgcggcaactgggtgtgcaccgccatgacctg cgacggcaagaatcagaagggcgcccagacccagaccgaagaagagatga ccagatacgtgcaggaactgcagaagcaccaggaaaccgccgaaaagacc aagcgggtgtccaccaaagatcgccgctgcccaccaccatcaccatca tcaccaccaccattga Nucleic acid sequence of mouse FSTL1 used in examples (SEQ ID NO: 320)

atgtggaagcggtggctggccctgagcctcgtgacaattgctctggtgca cggcgaggaagaacccagaagcaagagcaagatctgcgccaacgtgttct gcggagccggcagagaatgtgccgtgaccgagaagggcgagcctacctgc ctgtgcatcgagcagtgcaagcccacaagaggcctgtgtgcggcagcaa cggcaagacctacctgaaccactgcgagctgcaccgggatgcctgtctga ccggcagcaagatccaggtggactacgacggccactgcaaagagaagaag tccgccagccctagcgccagcccagtcgtgtgttaccaggccaaccggga cgagctgcggcggagactgattcagtggctggaagccgagatcatccccg acggctggttcagcaagggcagcaactacagcgagatcctggacaagtac ttcaagagcttcgacaacggcgacagccacctggacagcagcgagttcct gaagttcgtggaacagaacgagacagccatcaacatcaccacctacgccg accaggaaaacaacaagctgctgagaagcctgtgcgtggacgccctgatc gagctgagcgacgagaacgccgactggaagctgagctttcaggaatttct gaagtgcctgaaccccagcttcaaccccccgagaagaaatgcgccctgg aagatgagacatacgccgacggcgccgagacagaggtggactgcaataga tgcgtgtgcagctgcggccactgggtgtgcaccgccatgacctgcgacgg caagaaccagaaaggcgtgcagaccacaccgaggaagagaaaaccggct acgtgcaggaactgcagaagcaccagggcaccgccgaaaagaccaagaaa gtgaacaccaaagagatcgccgctgcccaccaccatcaccatcatcacca ccaccattga Human FSTL1 amino acid sequence (SEQ ID NO: 251)

MWKRWLALALALVAVAWVRAEEELRSKSKICANVFCGAGRECAVTEKGEP

TCLCIEQCKPHKRPVCGSNGKTYLNHCELHRDACLTGSKIQVDYDGHCKE

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCDGKNQKGAQTQTEEEMTRYVQELQKHQETAEKT

KRVSTKEI

Mouse FSTL1 amino acid sequence (SEQ ID NO: 253)

MWKRWLALSLVTIALVHGEEEPRSKSKICANVFCGAGRECAVTEKGEPTC

KCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

CVCSCGHWVCTAMTCDGKNQKGVQTHTEEEKTGYVQELQKHQGTAEKTKK

VNTKEI

Amino acid sequence of human FSTL1 used in Examples (SEQ ID NO: 319)

MWKRWLALALALVAVAWVRAEEELRSKSKICANVFCGAGRECAVTEKGEP

TCLCIEQCKPHKRPVCGSNGKTYLNHCELHRDACLTGSKIQVDYDGHCKE

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCKGKNQKGAQTQTEEEMTRYVQELQKHQETAEKT

KRVSTKEIAAAHHHHHHHHHH

Amino acid sequence of mouse FSTL1 used in Examples (SEQ ID NO: 320)

MWKRWLALSLVTIALVHGEEEPRSKSKICANVFCGAGRECAVTEKGEPTC

LCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

DVCSCGHWVCTAMTCDGKNQKGVQTHTEEEKTGYVQELQKHQGTAEKTKK

VNTKEIAAAHHHHHHHHHH

<Expression Vector Construction>

Next, the insertion of a multicloning site into pcDNA3.4TOPO® and a method for inserting the FSTL1 gene will be described.

The synthesis of sequences having a multicloning site given below was outsourced to FASMAC Corp. to synthesis single-stranded DNAs. Respective single-stranded DNAs are complementary to each other, and the synthesized single-stranded DNAs were prepared into a double strand and then inserted to pcDNA 3.4 TOPO® vector using pcDNA(TM) 3.4-TOPO® TA Cloning Kit (Life Technologies Corp., Cat # A14697).

Multicloning Site Sequence (SEQ ID NO: 322)
5'-AAGCTTGGATCCACTAGTGAATTCATCTACCAGCTAGCGTGGCATCT

AGACACTCTCGA GA-3'

(SEQ ID NO: 323)
5' CTCGAGAGTGTCTAGATGCCACGCTAGCTGGTAGATGAATTCACTAG

TGGATCCAAGCTT A-3'

E. coli was transformed with the plasmid obtained by the insertion of the multicloning site, and cultured, and plasmids were purified using PureYield™ Plasmid Midiprep System (Promega Corp., Cat # A2492). The purified plasmids were treated with restriction enzymes BamHI-HF (New England BioLabs Japan Inc. Cat # R3136L) and NheI-HF (New England BioLabs Japan Inc. Cat # R3131L) and subjected to 1% agarose electrophoresis. After the electrophoresis, the gels were stained with ethidium bromide, and the bands of the plasmids were excised. The plasmids were purified from the gels using NucleoSpin Gel and PCR Clean-up (Takara Bio Inc., Cat #740609.250).

The synthesized human FSTL1 (SEQ ID NO: 318) or mouse FSTL1 gene (SEQ ID NO: 320) was integrated into the plasmids treated with the restriction enzymes described above using GeneArt Seamless Cloning and Assembly Enzyme Mix (Invitrogen Corp., Cat # A14606), and E. coli was transformed with the resulting plasmids. The transformed E. coli was cultured. Plasmids were extracted and purified from the E. coli, and their DNA sequences were confirmed. Plasmids confirmed to have the intended human or mouse FSTL1 gene sequence as a result of the DNA sequencing were used as expression plasmids. The obtained human and mouse FSTL1 expression vectors were used in transient expression using Expi293™ Expression system (Life Technologies Corp., Cat # A14635). Culture supernatants after the expression were purified using HisPur Cobalt Resin (Thermo Fisher Scientific Inc., Cat #89964) and used as antigens for ELISA and epitope mapping ELISA.

<Preparation of FSTL1 Deletion Mutant>

Next, a method for preparing various deletion mutants will be shown. Expression vectors of deletion mutants were constructed using the human FSTL1 expression plasmid thus prepared as a template, primers for deletion mutant preparation, and KOD-Plus-Mutagenesis Kit (Toyobo Co., Ltd., Cat # SMK-101). The sites to be deleted were selected, except for sites rich in disulfide bond important for conformation, with reference to Uniprot No. Q12841 (see FIG. 34A) to prepare expression vectors of a deletion mutant containing deletion at amino acid positions 21 to 53 (Δ21-53), a deletion mutant containing deletion at amino acid positions 100 to 140 (Δ100-140), a deletion mutant containing deletion at amino acid positions 148 to 170 (Δ148-170), a deletion mutant containing deletion at amino acid positions 148 to 154 (Δ148-154), a deletion mutant containing deletion at amino acid positions 155 to 162 (Δ155-162), a deletion mutant containing deletion at amino acid positions 163 to 170 (Δ163-170), a deletion mutant containing deletion at amino acid positions 181 to 190 (Δ181-190), a deletion mutant containing deletion at amino acid positions 193 to 228 (Δ193-228), and a deletion mutant containing deletion at amino acid positions 233 to 289 (Δ233-289). These various deletion mutants were transiently expressed using Expi293™ Expression system.

Culture supernatants after the expression were purified using HisPur Cobalt Resin and used as antigens for epitope mapping ELISA.

Δ21-53 (Forward primer)
5'-TGCATCGAGCAGTGCAAGCCCCACA-3' (SEQ ID NO: 326)

Δ21-53 (Reverse primer)
5'-GGCGCGCACCCAAGCCACAGCCACC-3' (SEQ ID NO: 327)

Δ100-140 (Forward primer)
5'-AAGGGCAGCAACTACAGCGAGATCC-3' (SEQ ID NO: 328)

Δ100-140 (Reverse primer)
5'-TTTGCAGTGGCCGTCGTAGTCCACC-3' (SEQ ID NO: 329)

Δ148-170 (Forward primer)
5'-TTCGTGGAACAGAACGAGACAGCCA-3' (SEQ ID NO: 330)

Δ148-170 (Reverse primer)
5'-CTCGCTGTAGTTGCTGCCCTTGCTG-3' (SEQ ID NO: 331)

Δ181-190 (Forward primer)
5'-AAGCTGCTGCGGGGCCTGTGCGTGG-3' (SEQ ID NO: 332)

Δ181-190 (Reverse primer)
5'-GTTGATGGCTGTCTCGTTCTGTTCC-3' (SEQ ID NO: 333)

Δ193-228 (Forward primer)
5'-CCCGAGAAGAAGTGCGCCCTGGAGG-3' (SEQ ID NO: 334)

Δ193-228 (Reverse primer)
5'-CAGCTTGTTGTTTTCCTGGTCGGGG-3' (SEQ ID NO: 335)

Δ233-289 (Forward primer)
5'-CTGCAGAAGCACCAGGAAACCGCCG-3' (SEQ ID NO: 336)

Δ233-289 (Reverse primer)
5'-CTTCTTCTCGGGGGGGTTGAAGCTG-3' (SEQ ID NO: 337)

Δ148-154 (Forward primer)
5'-AACTTCGACAACGGCGACAGCAGACT-3' (SEQ ID NO: 338)

Δ148-154 (Reverse primer)
5'-CTCGCTGTAGTTGCTGCCCTTGCTG-3' (SEQ ID NO: 339)

Δ155-162 (Forward primer)
5'-CTGGACAGCAGCGAGTTCCTGAAGT-3' (SEQ ID NO: 340)

Δ155-162 (Reverse primer)
5'-CTTGAAGTACTTGTCCAGGATCTCG-3' (SEQ ID NO: 341)

Δ163-170 (Forward primer)
5'-TTCGTGGAACAGAACGAGACAGCCA-3' (SEQ ID NO: 342)

Δ163-170 (Reverse primer)
5'-TCTGCTGTCGCCGTTGTCGAAGTTC-3' (SEQ ID NO: 343)

Δ193-204 (Forward primer)
5'-AGCGACAGAGAACGCCGACTGG-3' (SEQ ID NO: 465)

ΔA193-204 (Reverse primer)
5'-CAGCTTGTTGTTTTCCTGGTCGGGG-3' (SEQ ID NO: 466)

Δ205-216 (Forward primer)
5'-GAATTTCTGAAGTGCCTGAAC-3' (SEQ ID NO: 467)

Δ205-216 (Reverse primer)
5'-CAGCTCAATCAGGGCGTCCAC-3' (SEQ ID NO: 468)

Δ217-228 (Forward primer)
5'-CCCGAGAAGAAGTGCGCCCTGGAGG-3' (SEQ ID NO: 469)

Δ217-228 (Reverse primer)
5'-CTGAAAGCTCAGCTTCCAGTC-3' (SEQ ID NO: 470)

Δ233-251 (Forward primer)
5'-AGATGCGTGTGCGCCTGCGGC-3' (SEQ ID NO: 471)

Δ233-251 (Reverse primer)
5'-CTTCTTCTCGGGGGGGTTGAAGCTG-3' (SEQ ID NO: 472)

Δ252-270 (Forward primer)
5'-AATCAGAAGGGCGCCCAGACC-3' (SEQ ID NO: 473)

Δ252-270 (Reverse primer)
5'-GTTGCAGTCCACCTCTGTCTCG-3' (SEQ ID NO: 474)

Δ271-289 (Forward primer)
5'-CTTCTTCTCGGGGGGGTTGAAGCTG-3' (SEQ ID NO: 475)

Δ271-289 (Reverse primer)
5'-CTTGCCGTCGCAGGTCATGGCG-3' (SEQ ID NO: 476)

-continued

Δ48-100 (Forward primer)
5'-AAGAAAAGCGTGTCCCCCAGC-3'          (SEQ ID NO: 477)

Δ48-100 (Reverse primer)
5'-CTTCTCGGTCACGGCACATTC-3'          (SEQ ID NO: 478)

<Epitope Mapping ELISA>

Epitope mapping ELISA was conducted using the antigens thus prepared and antibodies given below. Antibodies used: various chicken-mouse chimeric antibodies obtained in Example 1, a rat anti-FSTL1 antibody (R&D Systems, Inc., Cat. No. MAB1694, clone 229007) evaluated in Examples of the patent literature WO2009/028411, an anti-DNP antibody as a negative control, and a rat IgG2b isotype control (R&D Systems, Inc., Cat. No. MAB0061, clone 141945)

(Table 4 Epitope mapping ELISA conditions)

TABLE 2-4;

| 1 | Immobilized antigen: | 50 μL/well | O/N, 4° C. | 5 μg/mL various human FSTL1 deletion mutants |
|---|---|---|---|---|
| 2 | Blocking: | 250 μL/well | 60 min, 37° C. | 25% Block Ace/PBS |
| 3 | Primary antibody: | 50 μL/well | 60 min, 37° C. | Each antibody 1 μg/mL/10% Block Ace |
| 4 | Secondary antibody: | 50 μL/well | 60 min, 37° C. | HRP-anti-mouse IgG (H + L) or HRP-anti-Rat IgG (H + L) (Cell Signaling Technology/Inc., #7077S) in 10% Block Ace/PBS (1:1000) |
| 5 | Chromogenic substrate: | 50 μL/well | 30 min, RT | OPD solution |
| 6 | Reaction termination: | 50 μL/well | | 2N $H_2SO_4$ |
| 7 | Measurement: | Wavelength 490 nm/630 mn | | |

O/N means overnight.

Figure 34:
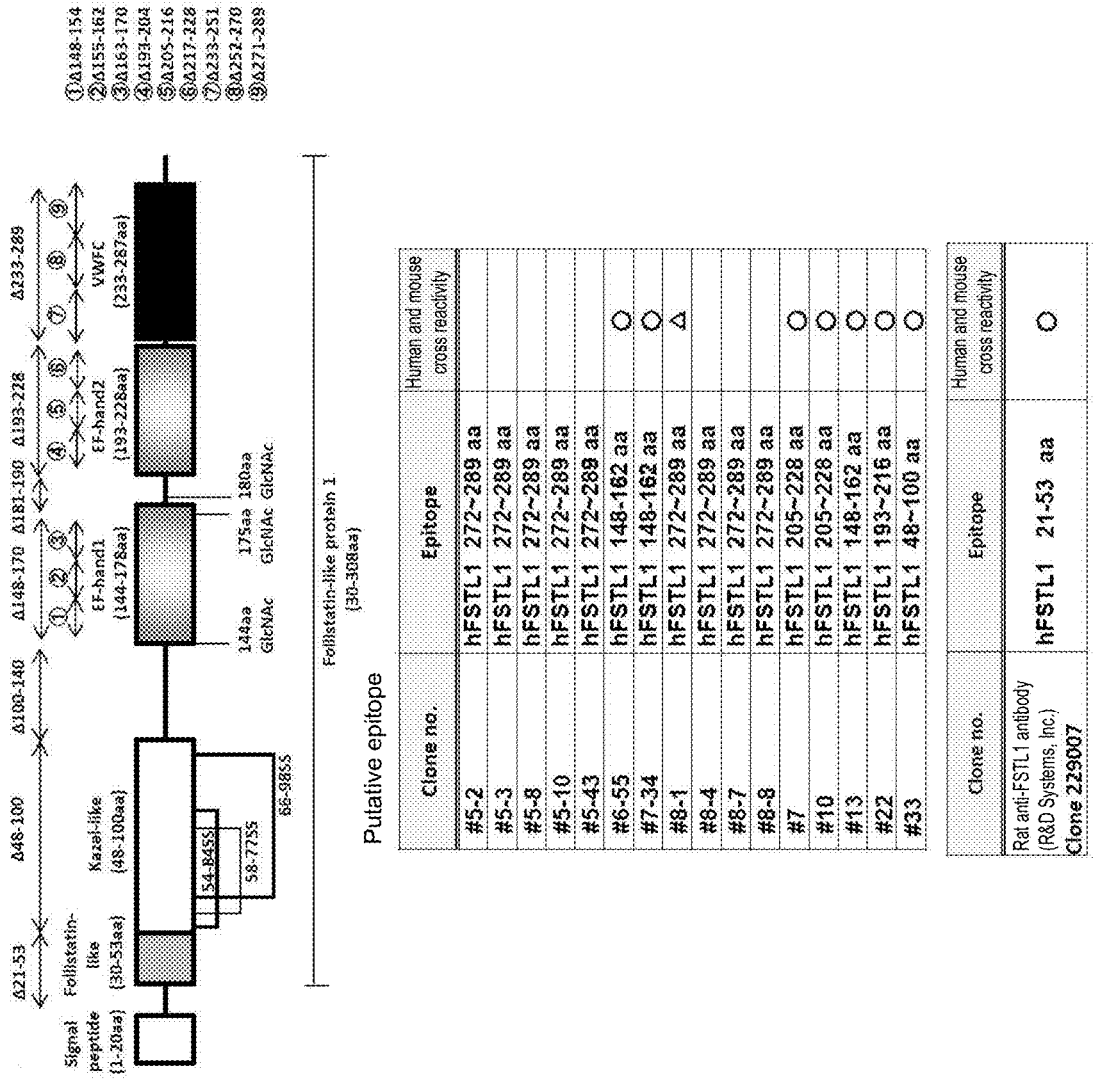
FIG. 34 shows deletion mutants and putative epitopes (Example 3). The upper diagram of FIG. 34 shows a schematic diagram of human FSTL1 and the positions of deletion sites. A putative epitope site for each clone was identified by ELISA using these deletion mutants of human FSTL1 as antigens. The lower diagram of FIG. 34 shows the comparison of putative epitopes between the obtained clones and a rat anti-FSTL1 antibody of R&D Systems, Inc. evaluated in Examples of Patent Literature 1 (WO2009/028411) in a table. Further, clones that exhibit the cross reactivity between humans and mice (strong binding activity: circle, weak binding activity: triangle) are described. As for criteria for strong or weak binding activity, binding activity found for both humans and mice at a concentration of 12.5 ng/ml was classified as "strong", and binding activity found for both humans and mice only at a higher concentration was classified as "weak".

The upper diagram of FIG. 34 shows a schematic diagram of human FSTL1 (with reference to Uniprot, No. Q12841) and the respective deletion sites of the prepared deletion mutants. As a result of the epitope mapping ELISA, the epitope site for each antibody is shown in the lower diagram of FIG. 34. As seen, #5-2, #5-3, #5-8, #5-10, #5-43, #8-1, #8-2, #8-4, and #8-7 were presumed to recognize a sequence contained in the amino acid sequence from positions 233 to 289 as an epitope, and #7, #10, and #22 were presumed to recognize a sequence contained in the amino acid sequence of positions 193 to 228 as an epitope. The epitope for the rat anti-FSLT1 antibody manufactured by R&D Systems, Inc. was predicted as a sequence contained in the amino acid sequence of positions 21 to 53 and thus found to be different from the epitopes for the various antibodies obtained in Example 1. #6-55, #7-34, and #13 were presumed to recognize a sequence contained in the amino acid sequence of positions 148 to 170 as an epitope. Further, these clones were judged as promising antibody clones by in vitro evaluation mentioned later. Therefore, the epitope sequence in the epitope-containing amino acid sequence of 148 to 170 was narrowed down. Specifically, a deletion mutant containing deletion at amino acid positions 148 to 154 (Δ148-154), a deletion mutant containing deletion at amino acid positions 155 to 162 (Δ155-162), and a deletion mutant containing deletion at amino acid positions 163 to 170 (Δ163-170) were prepared and subjected to epitope mapping ELISA in the same way as above. As a result, the epitope sites for #6-55, #7-34, and #13 are shown in the lower diagram of FIG. 34. As seen, these clones were presumed to recognize a sequence contained in the amino acid sequence of positions 148 to 162 as an epitope.

<Further Narrowing Down of Epitope>

The amino acid sequence of positions 148 to 170 (epitope for #6-55, #7-34, and #13), the amino acid sequence of positions 193 to 228 (epitope for #7, #10, and #22), and the amino acid sequence of positions 233 to 289 (epitope for #5-2, #5-3, #5-8, #5-10, #5-43, #8-1, #8-4, #8-7, and #8-8) were further fragmented as deletion sequences, and the epitope sequences were narrowed down. An epitope for clone #33 was identified.

The lower diagram of FIG. 34 reflects summary of these results. The putative epitope for #33 was present in the amino acid sequence of positions 48 to 100. The putative epitope for #7 and #10 was present in the amino acid sequence of positions 205 to 228. The putative epitope for #22 was present in the amino acid sequence of positions 193 to 216. The putative epitope for #5-2, #5-3, #5-10, #5-43, #8-1, #8-4, #8-7, and #8-10 was present in the amino acid sequence of positions 272 to 289.

Example 4: Evaluate of Inhibitory Activity Against Mesenchymal Stem Cell (MSC) Induction In this Example, inhibitory activity against the induction of mesenchymal stem cells (MSCs) by FSTL1 was evaluated.

It is known that when bone marrow cells are stimulated with FSTL1, mesenchymal stem cells (MSCs) having pluripotency or self-proliferative capacity grow (Cancer Research 73: 6185, 2013). Thus, $2 \times 10^7$ cells/well of bone marrow cells collected from the thigh bone of a C57BL/6 mouse were suspended in 3 mL/well of RPMI1640 (GIBCO/Thermo Fisher Scientific Inc., Cat. No. C11875500BT) medium containing 2% fetal bovine serum, supplemented with 50 ng/mL (final concentration) of FSTL1 (R&D Systems, Inc. Cat #1694-FN-050) and 10 μg/mL of the anti-FSTL1 antibody (#5-2, #5-3, #5-8, #5-10, #5-43, #6-55, or #7-34) or its isotype mouse IgG (anti-DNP antibody) as a control antibody "Control", and cultured under stimulation (6-well plate). 11 days thereafter, the number of cells was counted while the cells were stained with a PE-labeled anti-ALCAM antibody (eBioscience, Cat. No. 12-1661-82) and a PE-labeled anti-PDGFRA antibody (eBioscience, Cat #12-1401-81) in order to examine the expression of MSC markers, and the contents of ALCAM-positive cells and PDGFR-positive cells were analyzed by flow cytometry using FACScan (Becton, Dickinson and Company, Code. BECTON-DICKINSON-FACSCAN) to calculate the number of each positive cell per culture. As a result, all of the antibody clones exhibited inhibitory activity against the expansion of ALCAM-positive cells and PDGFRA-positive cells by FSTL1, as compared with the control antibody (anti-DNP antibody). Among them, #5-43, #6-55, and #7-34 exhibited slightly strong tendency of inhibitory activity.

Example 5: Evaluation of Inhibitory Activity Against Activation of Tumor Cell by FSTL1

In this Example, inhibitory activity against the activation of tumor cells by FSTL1 was evaluated.

It is known that tumor cells activated by stimulation with FSTL1 highly express molecule groups promoting bone metastasis and increase metastatic invasive capacity (Cancer Research 73: 6185, 2013). Thus, $2 \times 10^7$ cells/well of a human pancreatic cancer cell line Pancl were suspended in 1 mL/well of D-MEM medium (GIBCO/Thermo Fisher Scientific Inc. Cat. No. C11885500BT) containing 10% fetal bovine serum, supplemented with 50 ng/mL (final concentration) of FSTL1 (R&D Systems, Inc.) and 10 μg/mL of the anti-FSTL1 antibody (#5-2, #5-8, #5-10, #5-43, #6-55, or #7-34) or its isotype mouse IgG (anti-DNP antibody) as a control antibody "Control", and cultured under stimulation (6-well plate). 3 days thereafter, the number of cells was counted while the cells were stained with a PE-labeled anti-RANKL antibody (eBioscience Cat. No. 12-6619) and a PE-labeled anti-CCR2 antibody (R&D Systems, Inc. Cat. No. FAB151P) in order to examine the expression of markers indicating bone metastatic properties, and the contents of RANKL-positive cells and CCR2-positive cells were analyzed by flow cytometry using FACScan (Becton, Dickinson and Company) to calculate the numbers of cells per culture. As a result, all of the antibody clones exhibited inhibitory activity against the expansion of RANKL-positive cells by FSTL1, as compared with the control antibody (anti-DNP antibody). The results of this experiment revealed that when the content of RANKL-positive cells and the number of cells per culture were compared, the number of cells was confirmed to be more appropriate for evaluation. Therefore, in Examples below, judgment was made with the number of cells as an index.

Example 6: Evaluation of Inhibitory Activity Against Induction of Mesenchymal Stem Cell (MSC) by FSTL1

In this Example, the same experiment as in Example 4 was conducted.

Figure 35:
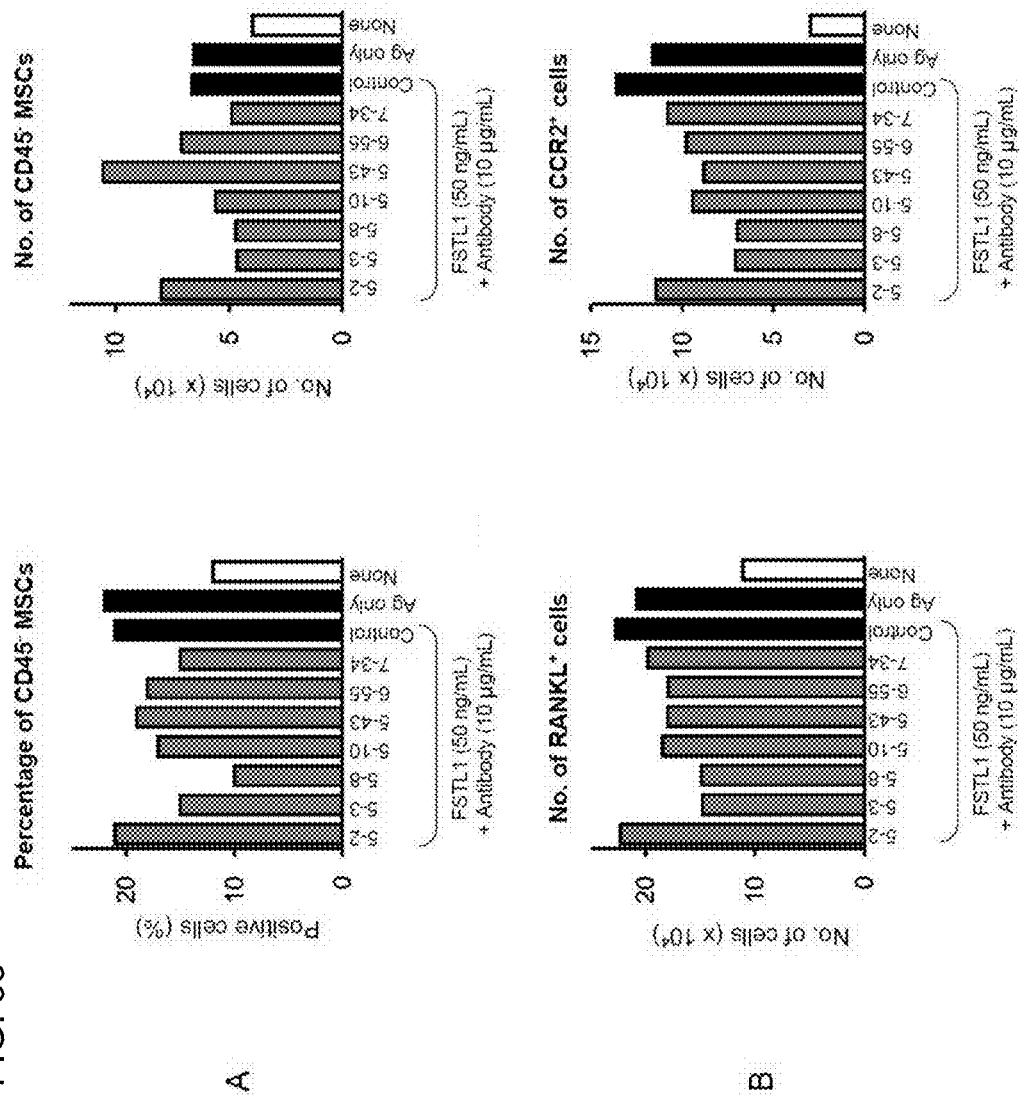
FIG. 35 shows results indicating effects brought about by the suppression of FSTL1 on mesenchymal stem cells (MSCs) and bone metastasis (Examples 6 and 7). Part A shows the influence of antibodies on an effect of inducing mouse bone marrow-derived mesenchymal stem cells by FSTL1 (Example 6). The proportion of mesenchymal stem cell (MSC) marker CD45-negative cells was analyzed by flow cytometry, and the percentage and number of the cells were shown. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity against the action of FSTL1, as compared with the control antibody (anti-DNP antibody). Among them, clone #5-3, #5-8, and #7-34 exhibited higher inhibitory activity and substantially completely inhibited the action of FSTL1. Part B shows the influence of antibodies on an effect of inducing RANKL- and CCR2-positive cells in a human pancreatic cancer cell line Panc1 by FSTL1 (Example 7). The expression of RANKL and CCR2 among molecules known as bone metastasis markers was analyzed by flow cytometry, and the numbers of positive cells were indicated in graphs. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity, as compared with the control antibody (anti-DNP antibody). Particularly, clone #5-3 and #5-8 exhibited higher inhibitory activity.

Mouse bone marrow cells prepared in the same way as in Example 4 were supplemented with 50 ng/mL (final concentration) of FSTL1 and 10 μg/mL of the anti-FSTL1 antibody (#5-2, #5-3, #5-8, #5-10, #5-43, #6-55, or #7-34) or a control antibody anti-DNP antibody and cultured under stimulation. 11 days thereafter, the number of cells was counted while the cells were stained with a PE-Cy5-labeled anti-CD45 antibody (BD Pharmingen/Becton, Dickinson and Company, Cat. No. 555484), and the content of CD45-negative cells reported to generally contain MSCs at a high rate was analyzed by flow cytometry using FACScan to calculate the percentage and number of MSCs per culture (FIG. 35A). As a result, all of the antibody clones exhibited inhibitory activity against the expansion of CD45-negative cells by FSTL1, as compared with the control antibody. Among them, #5-3, #5-8, #7-34, and #5-43 exhibited higher inhibitory activity and substantially completely inhibited the action of FSTL1.

Example 7: Evaluation of Inhibitory Activity Against Activation of Tumor Cell by FSTL1

In this Example, inhibitory activity against the activation of tumor cells by FSTL1 was evaluated in RANKL-positive cells and CCR2-positive cells.

In the same way as in Example 5, a human pancreatic cancer cell line Pancl was supplemented with 50 ng/mL (final concentration) of FSTL1 (R&D Systems, Inc.) and 10 μg/mL of the anti-FSTL1 antibody (the same clones as in Example 6) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 35B). As a result, all of the antibody clones exhibited inhibitory activity against the expansion of RANKL-positive cells and CCR2-positive cells, as compared with the control antibody. Among them, #5-3 and #5-8 exhibited higher inhibitory activity.

Example 8: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated in the same way as in Examples 4 and 6 except that the concentration was changed.

Figure 36A:
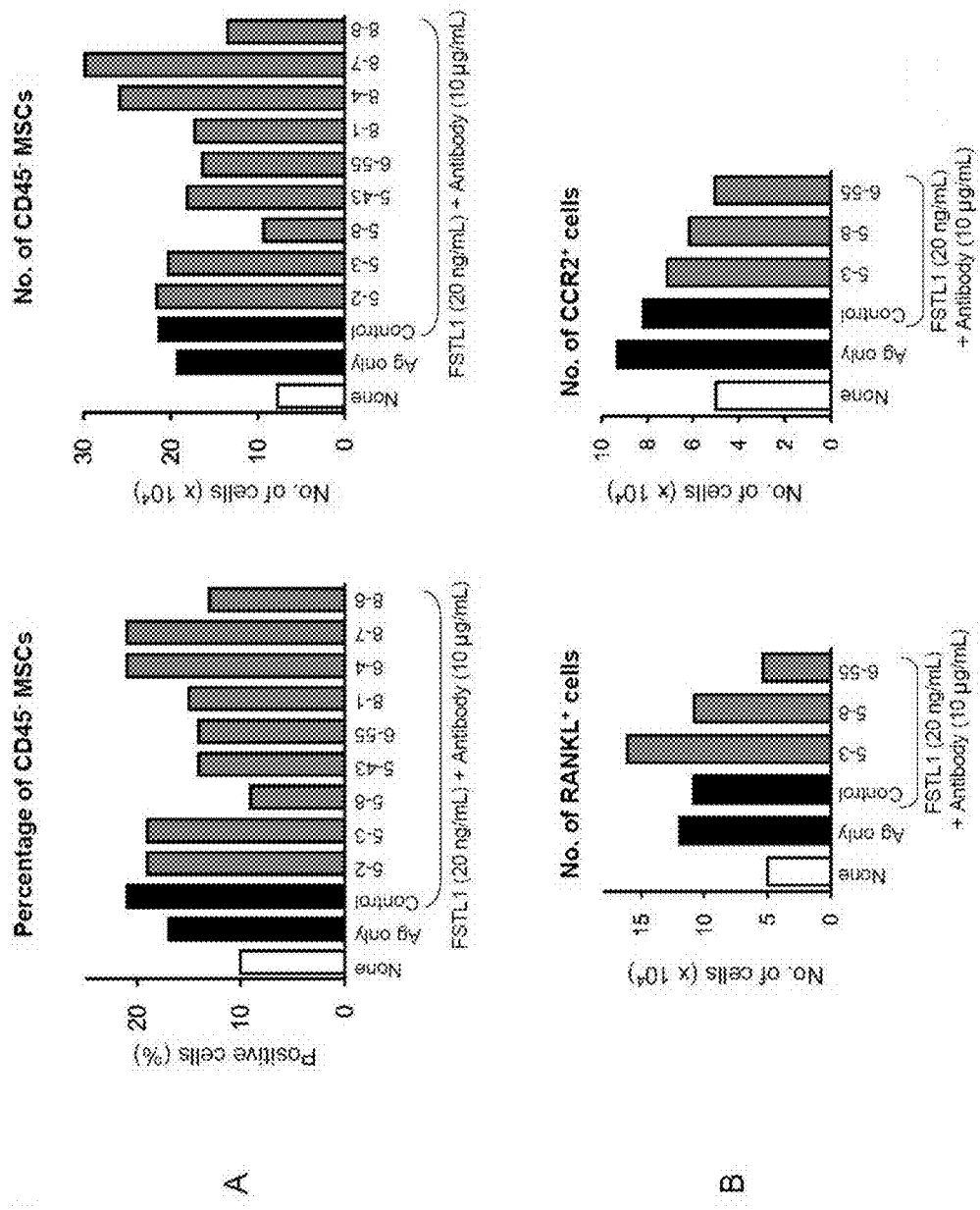
FIG. 36 also shows results indicating effects brought about by the suppression of FSTL1 on mesenchymal stem cells and bone metastasis (Examples 8 to 11). Part A shows the influence of antibodies on an effect of inducing mouse bone marrow-derived mesenchymal stem cells by FSTL1 (Example 8; the FSTL1 concentration was set to a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Inhibitory activity was confirmed in clone #5-8, #5-43, #6-55, #8-1, and #8-8. Part B shows the influence of antibodies on an effect of inducing RANKL- and CCR2-positive cells in a human pancreatic cancer cell line Panc1 by FSTL1 (Example 9; the FSTL1 concentration was set to a low concentration of 20 ng/ml). The expression of RANKL and CCR2 among molecules known as bone metastasis markers was analyzed by flow cytometry, and the numbers of positive cells were indicated in graphs. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. Clone #5-8 and #6-55 exhibited higher inhibitory activity.
FIG. 36B Part C shows the influence of antibodies on an effect of inducing RANKL- and CCR2-positive cells in a human pancreatic cancer cell line Panc1 by FSTL1 (Example 10). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity, as compared with the control antibody (anti-DNP antibody). Particularly, clone #5-2, #6-55, #8-4, and #8-7 exhibited higher inhibitory activity. Part D shows the influence of an antibody on an effect of inducing RANKL- and CCR2-positive cells in a human pancreatic cancer cell line Panc1 by FSTL1. Here, an antibody dose dependence test was conducted (Example 11). The expression of RANKL and CCR2 among molecules known as bone metastasis markers was analyzed by flow cytometry, and the numbers of positive cells were indicated in graphs. Clone #6-55 exhibited inhibitory activity, as compared with the control antibody (anti-DNP antibody), though the dose dependence of the antibody was not confirmed. The clone shown in the graphs is depicted on the right bars, a control antibody (anti-DNP antibody) is depicted on the third bar from the left, an antigen alone is depicted on the second bar from the left, and a non-supplemented sample is depicted on the leftmost bar. Clone #6-55 strongly inhibited the cell induction of both RANKL-positive cells and CCR2-positive cells at the same time.

Mouse bone marrow cells prepared in the same way as in Example 4 were supplemented with 20 ng/mL (final concentration) of FSTL1 and 10 μg/mL of the anti-FSTL1 antibody (#5-2, #5-3, #5-8, #5-10, #5-43, #6-55, #8-1, #8-4, #8-7, and #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 36A). As a result, #5-8, #5-43, #6-55, #8-1, and #8-4 exhibited inhibitory activity against the expansion of CD45-negative cells by FSTL1, as compared with the control antibody.

Example 9: Evaluation of Inhibitory Activity Against Activation of Tumor Cell by FSTL1

In this Example, inhibitory activity against the activation of tumor cells by FSTL1 was evaluated at lower concentration.

Figure 36B:
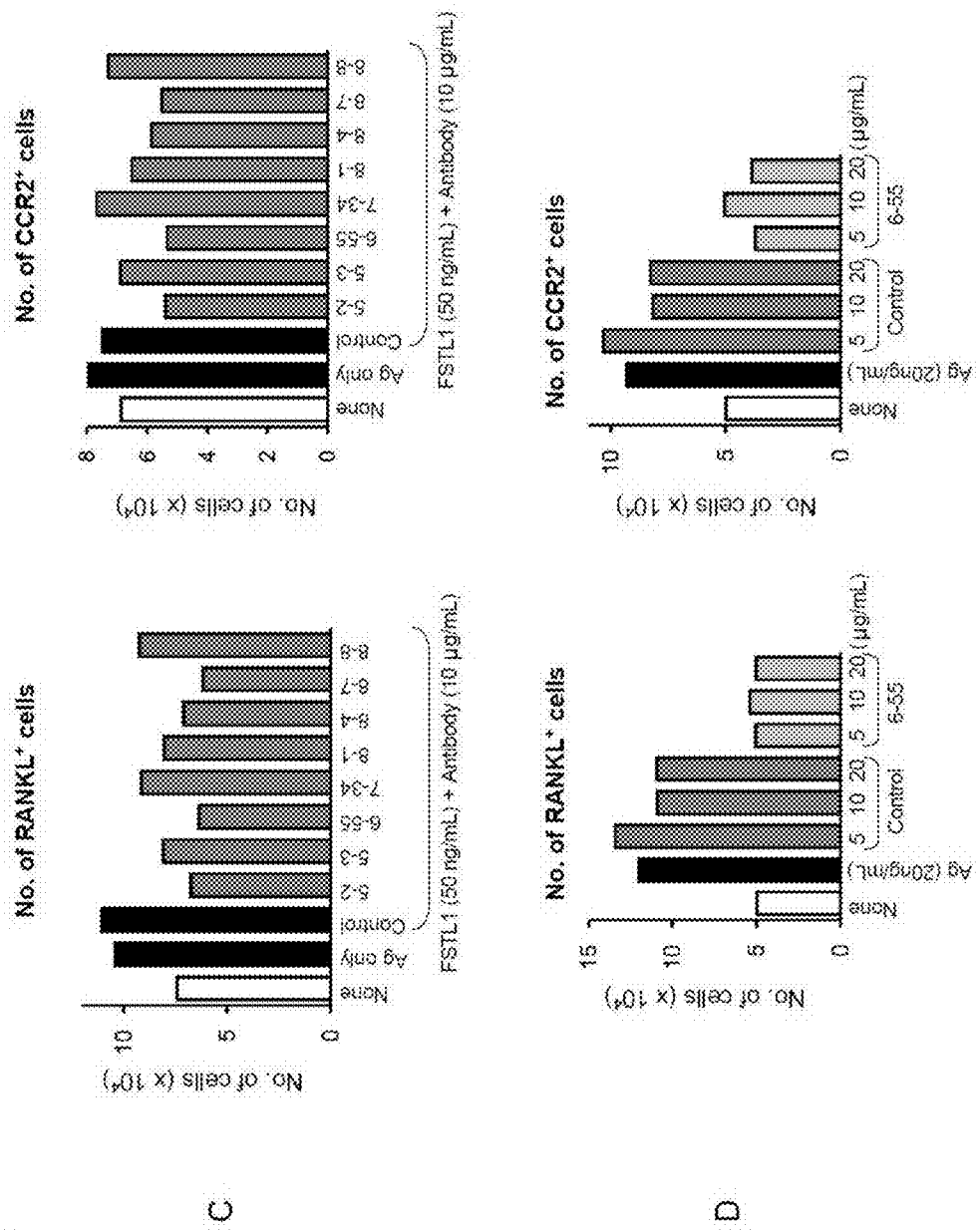

In the same way as in Example 5, a human pancreatic cancer cell line Pancl was supplemented with 20 ng/mL (final concentration) of FSTL1 and 10 μg/mL of the anti-FSTL1 antibody (#5-2, #5-8, or #6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 36B). As a result, #5-8 and #6-55 also exhibited inhibitory activity against the expansion of RANKL-positive cells and CCR2-positive cells using the concentration of 20 ng/mL (final concentration), as compared with the control antibody.

Example 10: Evaluation of Inhibitory Activity Against Activation of Tumor Cell by FSTL1

In this Example, inhibitory activity against the activation of tumor cells by FSTL1 was evaluated, also including newly obtained clones.

In the same way as in Example 5, a human pancreatic cancer cell line Pancl was supplemented with 50 ng/mL (final concentration) of FSTL1 and 10 μg/mL of the anti-FSTL1 antibody (#5-2, #5-3, #6-55, #7-34, #8-1, #8-4, #8-7, or #8-8) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, #5-2, #6-55, #8-4, and #8-7 exhibited high inhibitory activity against the expansion of RANKL-positive cells and CCR2-positive cells, as compared with the control antibody (FIG. 36C).

Example 11: Evaluation of Inhibitory Activity Against Activation of Tumor Cell by FSTL1 (Dose Dependence Test)

In this Example, inhibitory activity against the activation of tumor cells by FSTL1 was evaluated at varying doses including a low dose.

In the same way as in Example 5, a human pancreatic cancer cell line Panc1 was supplemented with 50 ng/mL (final concentration) of FSTL1 and 10 µg/mL of the anti-FSTL1 antibody (#6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, the tested #6-55 exhibited substantially 100% inhibitory activity against the expansion of RANKL-positive cells and CCR2-positive cells at all of the tested doses (5 µg/mL, 10 µg/mL, and 20 µg/mL), as compared with the control antibody, though the dose dependence of antibody was not confirmed (FIG. 36D).

Example 12: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated, including further clones.

Figure 37:
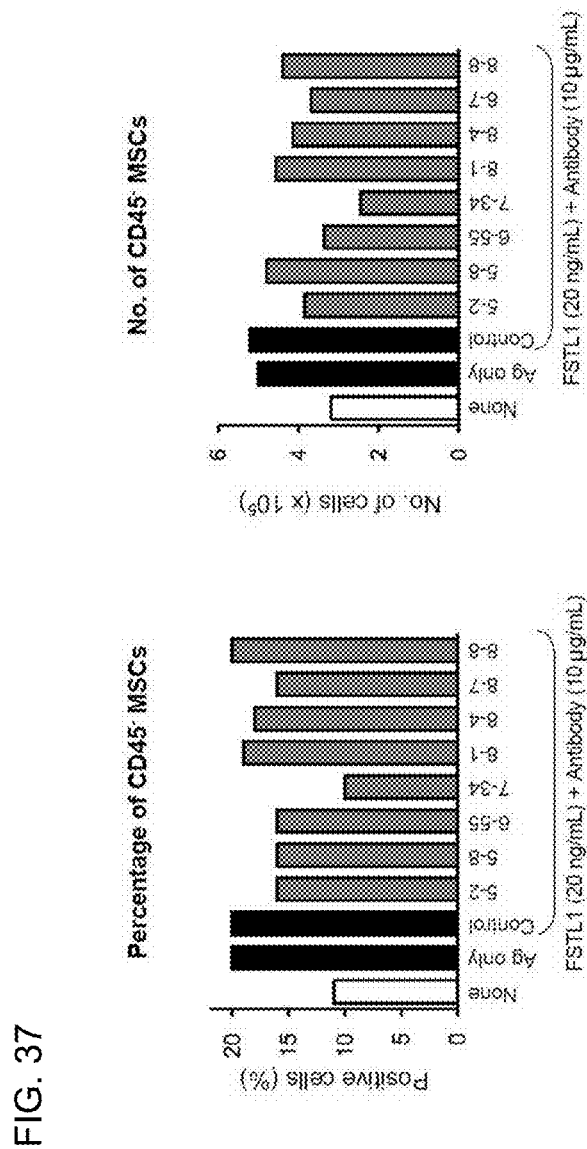
FIG. 37 shows the influence of antibodies on an effect of inducing mouse bone marrow-derived mesenchymal stem cells by FSTL1 (Example 12; the FSTL1 concentration used was a low concentration of 20 ng/ml). The proportion of mesenchymal stem cell (MSC) marker CD45-negative cells was analyzed by flow cytometry, and the percentage and number of the cells were shown. The clones shown in the graphs are depicted on the right bars, a control antibody (anti-DNP antibody) is depicted on the third bar from the left, an antigen alone is depicted on the second bar from the left, and a non-supplemented sample is depicted on the leftmost bar. All of the antibody clones exhibited inhibitory activity against the action of FSTL1, as compared with the control antibody (anti-DNP antibody). Particularly, stronger inhibitory activity was confirmed in the order of clone #7-34, #5-2, #6-55, and #8-7.

Mouse bone marrow cells prepared in the same way as in Example 4 were supplemented with 20 ng/mL (final concentration) of FSTL1 and 10 µg/mL of the anti-FSTL1 antibody (#5-2, #5-8, #6-55, #7-34, #8-1, #8-4, #8-7, or #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 37). As a result, all of the clones exhibited inhibitory activity against the expansion of CD45-negative cells by FSTL1, as compared with the control. Particularly, higher inhibitory activity was confirmed in the order of #7-34, #5-2, #6-55, and #8-7.

<Example 13: Evaluation of Inhibitory Activity Against Induction of Mesenchymal Stem Cell (MSC), Cancer-Associated MSC, and Myeloid-Derived Suppressor Cell (MDSC) by FSTL1>

In this Example, inhibitory activity against the induction of mesenchymal stem cells (MSC), cancer-associated MSCs, and myeloid-derived suppressor cells (MDSCs) by FSTL1 was evaluated.

Figure 38:
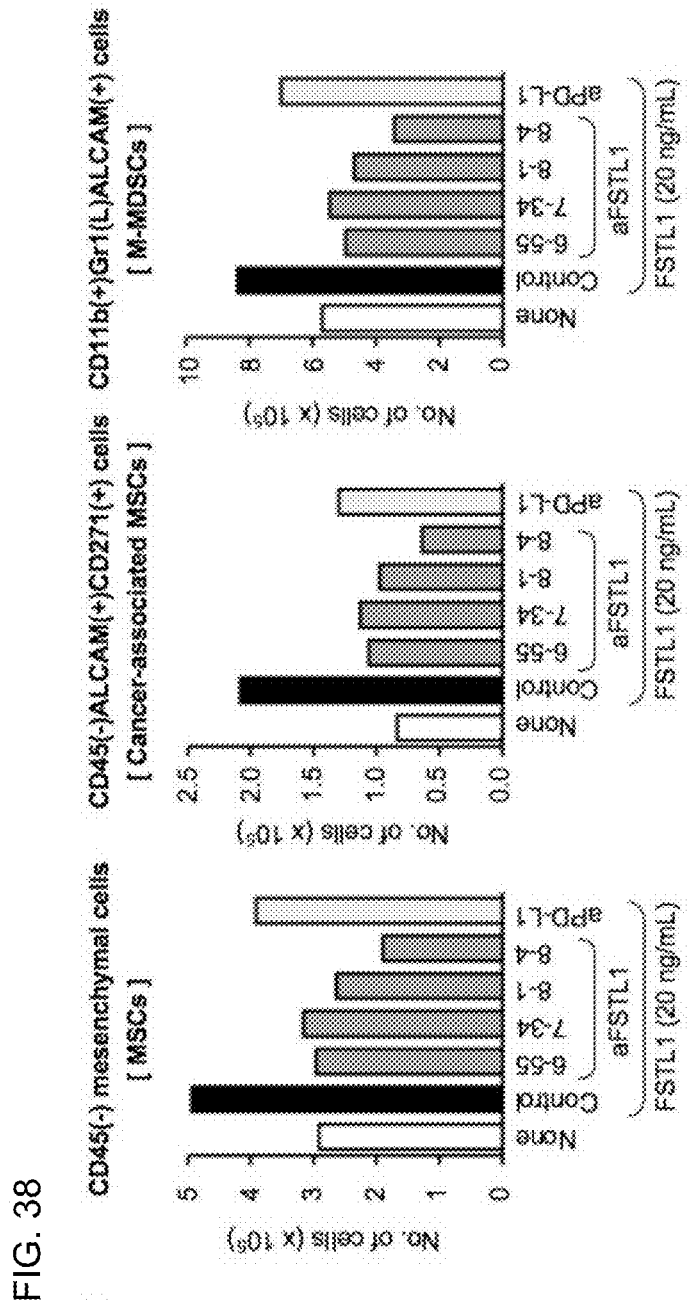
FIG. 38 shows results of evaluating the activity of anti-FSTL1 antibodies and an anti-PD-L1 antibody produced for in vivo (Example 13). Mouse bone marrow cells were supplemented with FSTL1 and each antibody and cultured. "CD45-negative cells" which includes MSCs with high probability (left graph), "CD45-negative, ALCAM-positive, and CD271-positive cells" which are MSCs increasing in number in association with cancer metastasis (middle graph), and "CD11b-positive, Gr1-positive, and ALCAM-positive cells" which are myeloid-derived suppressor cells (MDSCs) (right graph) were analyzed by flow cytometry, and the numbers of cells were shown. In each graph, none is depicted in the leftmost bar, a control antibody is depicted in the second bar from the left, the anti-PD-L1 antibody is depicted in the rightmost bar, and intermediate 4 clones respectively represent the anti-FSTL1 antibodies. These antibodies produced for in vivo were found to be appropriate antibodies because all of the antibodies exhibited high inhibitory activity, as in the results mentioned above, as compared with the control antibody. PD-L1 is expressed in MSCs and presumably influences the induction of MSCs. However, inhibitory activity was found to be stronger in the anti-FSTL1 antibodies.

Mouse bone marrow cells prepared in the same way as in Example 4 were supplemented with 20 ng/mL (final concentration) of FSTL1 and 10 µg/mL of the anti-FSTL1 antibody (#6-55, #7-34, #8-1, or #8-4), an anti-PD-L1 antibody reported to have an immunosuppression-mitigating effect, or a control antibody anti-DNP antibody and cultured under stimulation. 8 days thereafter, the number of cells was counted while the cells were stained with a PE-Cy5-labeled anti-CD45 antibody, a PE-labeled anti-ALCAM antibody, a FITC-labeled anti-CD271 antibody (Abcam plc, Cat. No. AB62122), a FITC-labeled anti-CD11b antibody (BD Pharmingen/Becton, Dickinson and Company, Cat. No. 553310), and a PE-Cy5-labeled anti-Gr1 antibody (eBioscience, Cat. No. 15-5931) in order to detect MSCs (CD45-negative cells), cancer-associated MSCs (CD45-negative, ALCAM-positive, and CD271-positive cells) which are MSCs increasing in number in association with cancer metastasis, and monocytic myeloid-derived suppressor cells (M-MDSCs: CD11b-positive, Gr1-positive, and ALCAM-positive cells) increasing in number together with cancer-associated MSCs, and the contents of the cells mentioned above were analyzed by flow cytometry using FACScan to calculate the percentage and number of MSCs per culture (FIG. 38). As a result, all of the clones exhibited high inhibitory activity against the induction of MSCs, cancer-associated MSCs, and M-MDSCs by FSTL1, as compared with the control antibody. PD-L1 is expressed in MSC and presumably influences the induction of MSCs. However, inhibitory activity was found to be stronger in the anti-FSTL1 antibodies.

Example 14: Evaluation of Inhibitory Activity Against Induction of Mesenchymal Stem Cell (MSC), Cancer-Associated MSC, and Myeloid-Derived Suppressor Cell (MDSC) by FSTL1, and Evaluation of Ability to Differentiate into Adipocyte)

In this Example, inhibitory activity against the induction of mesenchymal stem cells (MSCs), cancer-associated MSCs, and myeloid-derived suppressor cells (MDSCs) by FSTL1 was evaluated.

The antibody clone (#6-55, #7; #10, #13, or #22) was evaluated for its activity by the same testing method as in Example 13. #6-55 was set as a positive control for activity. As a result, all of the clones exhibited inhibitory activity against the induction of MSCs, cancer-associated MSCs, and M-MDSCs by FSTL1, as compared with the control antibody. Among them, #13 exhibited inhibitory activity equivalent to or higher than that of the positive control (FIG. 39A). These results seem to be reasonable because epitopes for #13 and #6-55 are the same regions. FIG. 39B shows results of analyzing inhibitory activity against the induction of MSCs having the ability to differentiate into adipocytes. Mouse bone marrow cells were supplemented with FSTL1 and the predetermined concentration of each antibody and cultured for 8 days. $5\times10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation. In the graph, none is depicted in the leftmost bar, and the control antibody is depicted in the second bar from the left followed by the anti-FSLT1 antibody clones. Adipocytes were not confirmed for any of the anti-FSLT1 antibodies. It is understood that the differentiation induction of MSCs serving as the original source is inhibited.

Example 15: Comparison with Conventional Antibody

In this Example, activity was compared with an anti-FSTL1 antibody (manufactured by R&D Systems, Inc.) evaluated in Examples of Patent Literature 1 (WO2009/028411).

FSTL1 inhibitory activity was compared between the rat anti-FSTL1 antibody of R&D Systems, Inc. (Cat. No. MAB1694, clone 229007) found in Patent Literature 1 (WO2009/028411) to exhibit inhibitory activity against the induction of regulatory T cells important for immunosuppression, and #6-55 of the present invention.

Mouse bone marrow cells (bone marrow cells prepared in the same way as in Example 4) were supplemented with 20 ng/mL (final concentration) of FSTL1 and 20.0, 10.0, 5.0, or 2.5 µg/ml (final concentration) of the rat anti-FSTL1 antibody or #6-55. Also, mouse bone marrow cells were supplemented with 20.0 µg/ml (final concentration) each of their respective control antibodies, a rat IgG2b isotype control (R&D Systems, Inc., Cat. No. MAB0061, clone 141945) and an anti-DNP antibody. The cells were cultured for 8 days, and the inhibitory activity of each antibody against the induction of MSCs, cancer-associated MSCs, and M-MDSCs by FSTL1 was evaluated in the same way as in Example 13 (FIG. 40A). As a result, the inhibitory activity of the rat anti-FSTL1 antibody and the antibody of #6-55 was at the same level. On the other hand, dose dependence was not confirmed. The inhibition of regulatory T cells shown in Patent Literature 1 (WO2009/028411) is presumably a consequence mediated by the inhibition of MSC induction.

Example 16: Evaluation of Inhibitory Activity Against Induction of Mesenchymal Stem Cell (MSC) by FSTL1 (Evaluation of Ability to Differentiate into Adipocyte)

In this Example, the ability to differentiate into adipocytes was evaluated in order to evaluate inhibitory activity against an effect of inducing mesenchymal stem cell (MSC)-mediated immunosuppression by FSTL1.

In the same way as in Example 15, mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation (FIG. 40B). As a result, cells differentiating into adipocytes decreased in number by the addition of #6-55 in a dose-dependent manner, as compared with the anti-DNP antibody (mouse IgG control group). On the other hand, in the case of adding the rat anti-FSTL1 antibody of R&D Systems, Inc., no influence was confirmed on differentiation into adipocytes, and a large number of adipocytes were observed at all of the doses, as in the rat IgG2b isotype control group. Specifically, not all of cells in a CD45-negative cell population are MSCs, and this population is merely a cell population containing MSCs at a high rate. It was shown that although the CD45-negative cells decreased in number by the rat anti-FSTL1 antibody of R&D Systems, Inc., there still remained many MSCs differentiating into adipocytes.

Example 17: In Vivo Antibody Activity Evaluation-Intratumoral Administration

In this Example, the drug efficacy of the anti-FSTL1 antibody was evaluated by intratumoral administration using bone metastasis models having a transplant of mouse melanoma B16-F10 cells forced to express Snail.

<Method and Material>

Three antibodies were comparatively analyzed for their antitumor effects and an immunosuppression-mitigating effect using bone metastasis models in which mouse melanoma cells B16-F10 forced to express Snail were subcutaneously and intravenously transplanted in C57BL/6N mice.

Figure 41A:
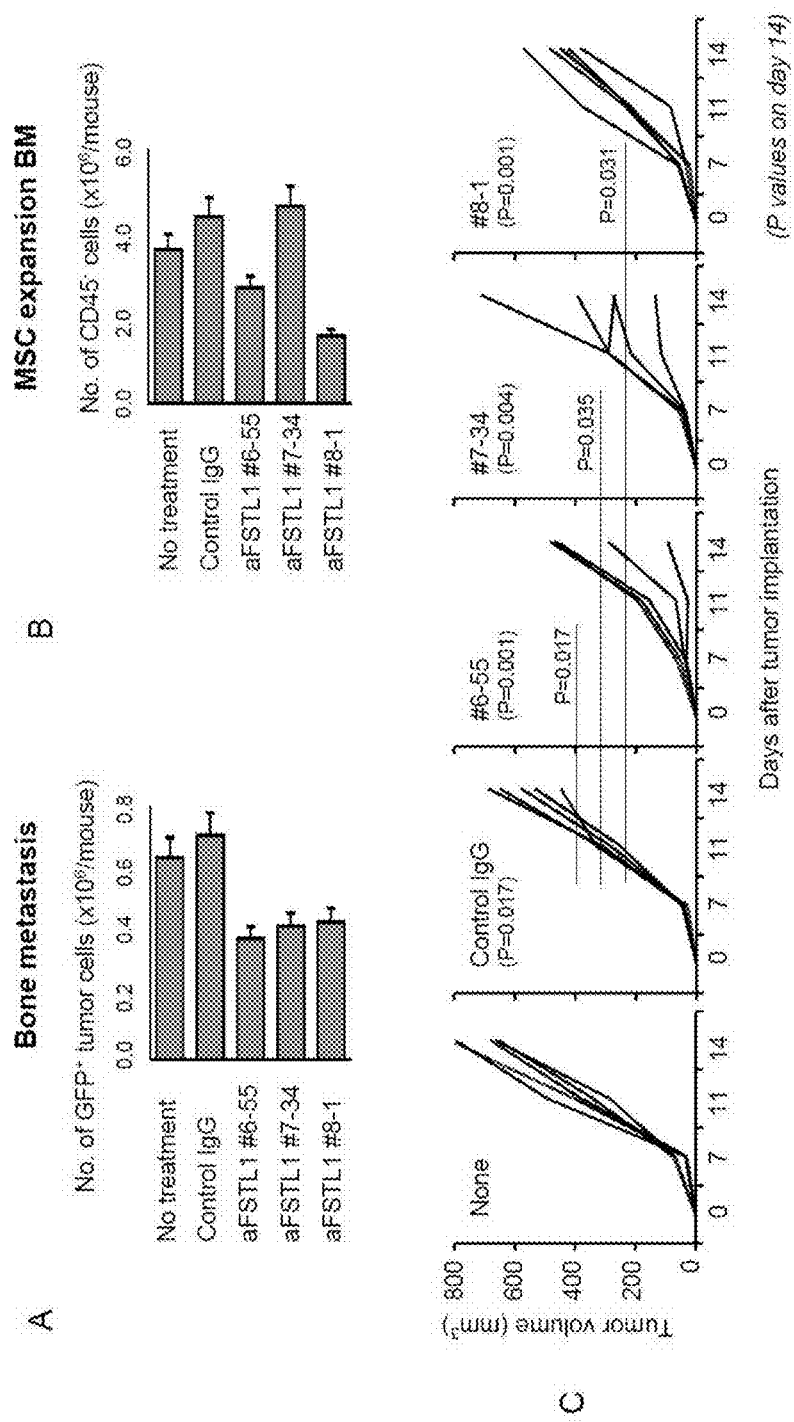
FIG. 41A shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 µg/0.1 mL/tumor). On day 14, various assays were conducted. Part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). Part B (the number of CD45-negative cells in bone marrow) shows results of analyzing the percentage (%) of CD45-negative cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). In both bar graphs, groups respectively receiving no treatment, a control antibody, clone #6-55, #7-34, and #8-1 are depicted from the upper to lower bars. Part C (tumor volume of each mouse individual) shows the tumor volume of each mouse individual (one line represents one mouse) measured 7, 11, and 14 days after tumor implantation, and shows the effects of various antibodies on tumor growth (subcutaneously transplanted tumor growth was suppressed). Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34.

1. Experiment group (n=5)
1. No treatment
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5 \times 10^5$ cells subcutaneously & $1 \times 10^5$ cells intravenously)
Day 7: intratumoral administration of the antibody (200 µg/0.1 mL/tumor)
Day 14: various assays (with a focus on flow cytometry analysis)
3. Index for drug efficacy evaluation
Effects on the growth of subcutaneous tumor (calculation of tumor volume by tumor size measurement): measured 7, 11, and 14 days after tumor implantation (FIG. 41C)
Effects on bone metastasis (GFP-positive tumor cells in bone marrow) (FIG. 41A)
Effects on the expansion of mesenchymal stem cells (CD45-negative cells in bone marrow and in the spleen) (FIGS. 41B and 41D)
Effects on the expansion of immunosuppressive Treg cells (CD4-positive and Foxp3-positive cells in bone marrow or the spleen) (FIG. 41D)
Other immunosuppressive properties (FIG. 41D)

DESCRIPTION

In order to evaluate in vivo antibody activity, antitumor effects and immunosuppression-mitigating effects were comparatively analyzed using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 µg/0.1 mL/tumor). On day 14, various assays were conducted.

Figure 41B:
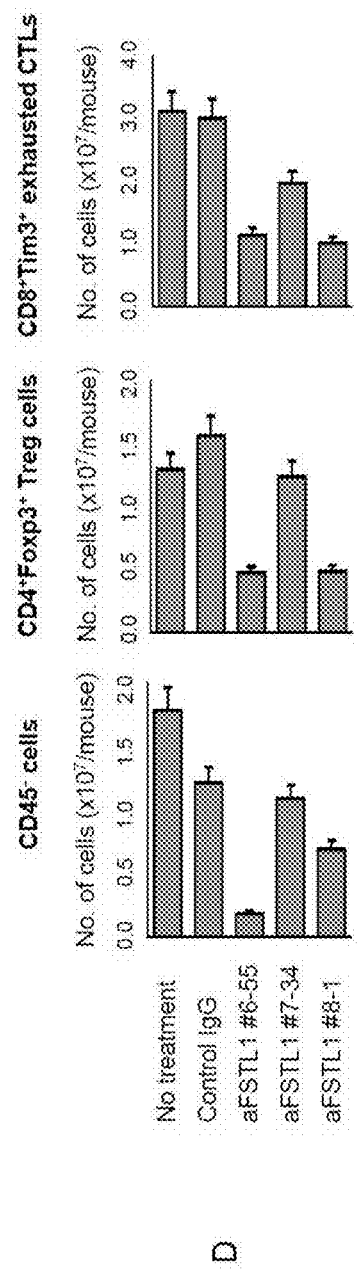
FIG. 41B shows results of evaluating antibody activity in vivo (Example 17) and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 µg/0.1 mL/tumor). On day 14, various assays were conducted. Part D shows change in cell populations in the spleen. As presented, even if an antibody is administered locally, for example, into tumor, the whole body receives modification or influence. The left graph shows the number of CD45-negative cells and shows that MSCs also decrease in number in the spleen. The middle graph shows the number of CD4-positive and Foxp3-positive T cells and shows that Tregs decrease in number. The right graph shows the number of CD8-positive and Tim3-positive T cells and shows that exhausted CD8-positive T cells decrease in number. In this context, the exhaustion refers to a state having functional decline or dysfunction. Tim3 is a marker that reflects the state. If CD8-positive T cells supposed to kill tumor cells fall into an exhausted state, cancer cells cannot be eliminated from the living body.

It is known that when Snail-positive tumor cells are subcutaneously or intravenously transplanted to mice, the tumor metastasizes preferentially to bone marrow in addition to various organs, and this incurs the expansion of mesenchymal stem cells (MSCs) originating in the bone marrow, thereby systemically and strongly suppressing the induction of antitumor immunity (Cancer Research 73: 6185, 2013). Thus, GFP-positive and Snail-positive B16-F10 tumor cells forced to express GFP and Snail by the transfer of the GFP gene and the mouse Snail gene were transplanted subcutaneously ($5 \times 10^5$ cells) and into the tail vein ($1 \times 10^5$ cells). 7 days thereafter, 10 mg/kg of the anti-FSTL1 antibody (#6-55, #7-34, or #8-1) or its isotype control antibody mouse IgG (anti-DNP antibody) adjusted to 1 mg/ml with saline was inoculated into tumor (5 mice/group). First, subcutaneous tumor size was measured before assays, and the tumor volume was calculated to evaluate an inhibitory effect on subcutaneous tumor growth (FIG. 41C (change of each individual is shown)). 7 days after antibody administration (14 days after tumor implantation), bone marrow cells or spleen cells were collected from the mice, and the number of cells per mouse was counted while drug efficacy was comparatively analyzed in more detail by flow cytometry analysis using FACScan (Becton, Dickinson and Company). Specifically, a) the content of GFP-positive and Snail-positive B16-F10 tumor cells in the bone marrow cells was analyzed to evaluate an inhibitory effect on bone metastasis (FIG. 41A). The percentage (%) of $CD45^-$ cells in the bone marrow cells was analyzed by flow cytometry. Then, the number of CD45-negative bone marrow cells ($\times 10^6$ cells) per mouse was counted on the basis of this data (FIG. 41B). The effects of various antibodies on MSC expansion in bone marrow are shown. b) The content of CD45-negative cells in the spleen was analyzed (PE-Cy5-labeled anti-CD45 antibody, Becton, Dickinsoft and Company) to evaluate an inhibitory effect on MSC expansion (left graph of FIG. 41D). c) The contents of immunosuppressive CD4-positive and Foxp3-positive cells (PE-labeled anti-CD4 antibody, Becton, Dickinson and Company; FITC-labeled anti-Foxp3 antibody, eBioscience) (middle graph of FIG. 41D) which are reportedly induced by MSCs, and CD8-positive and Tim3-positive T cells (CyChrome-labeled anti-CD8 antibody, Becton, Dickinson and Company; FITC-labeled anti-Tim3 antibody, R&D Systems, Inc.) exhausted to fall into dysfunction (right graph of FIG. 41D) were analyzed in bone marrow or the spleen to evaluate an immunosuppression-mitigating effect.

(Results)

The results are shown in FIG. 41. Antitumor effects and immunosuppression-mitigating effects, etc. were comparatively analyzed using bone metastasis models in which mouse melanoma cells (B16-F10) forced to express Snail were subcutaneously and intravenously transplanted in C57BL/6N mice. Intratumoral administration was performed as a method for administering the anti-FSTL1 antibody to be tested. All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34. FIG. 41D shows change in cell populations in the spleen. As shown, even if an antibody is administered locally, for example, into tumor, the whole body receives modification or influence. The left graph of FIG. 41D shows the number of CD45-negative cells and shows that MSCs also decrease in number in the spleen. The middle graph of FIG. 41D shows that CD4-positive and Foxp3-positive T cells decrease in number and shows that Tregs (regulatory T cells) decrease in number. The right graph of FIG. 41D shows the number of CD8-positive and Tim3-positive T cells and demonstrated that exhausted CD8-positive T cells decrease in number. In this context, the "exhaustion" refers to a state having functional decline or dysfunction. Tim3 is a marker that reflects the state. If CD8-positive T cells supposed to kill tumor cells fall into an exhausted state, cancer cells cannot be eliminated from the living body. Thus, it can be concluded that the effects of the present invention exhibit remarkable effects of suppressing the enhancement of such immunosuppression.

Example 18: In Vivo Antibody Activity Evaluation-Intraperitoneal Administration

In this Example, the drug efficacy of the anti-FSTL1 antibody was evaluated by systemic administration (intraperitoneal administration) using bone metastasis models having a transplant of mouse melanoma B16-F10 cells forced to express Snail.

Figure 42A:
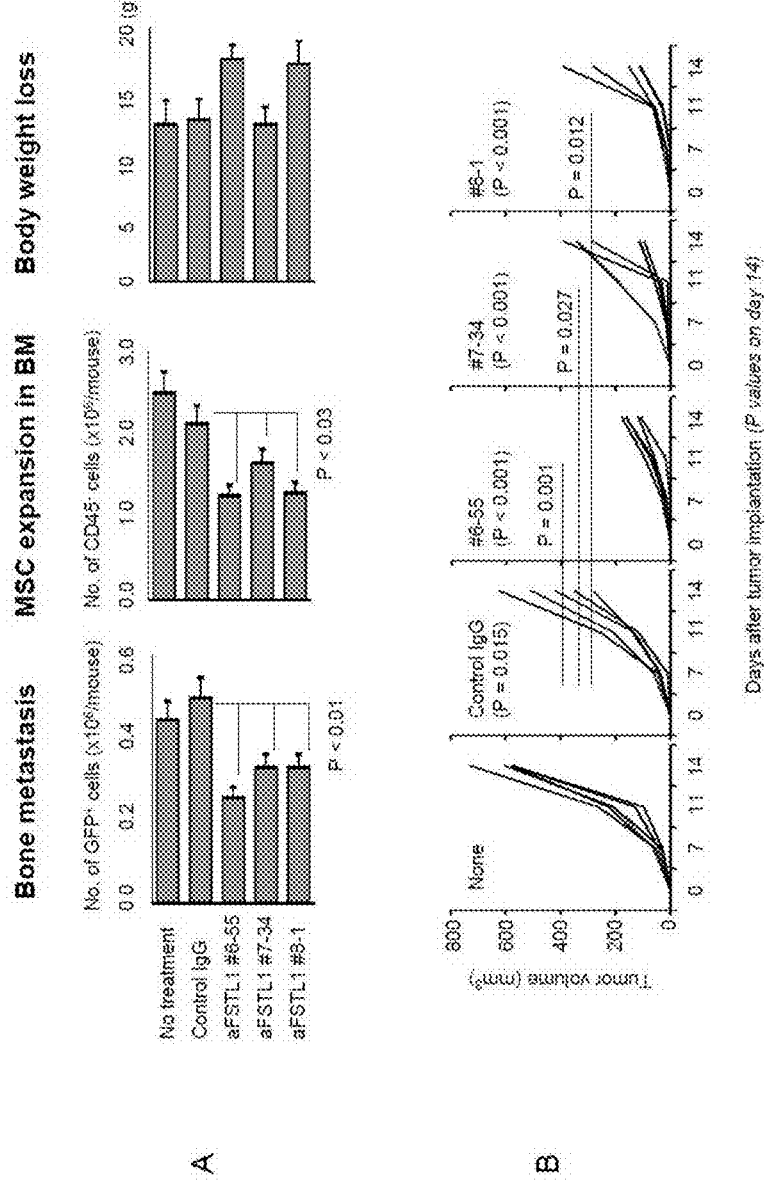
FIG. 42A also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5 \times 10^5$ cells subcutaneously & $1 \times 10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. The left graph of Part A (the number of tumor cells that metastasized into bone marrow) shows results of analyzing the percentage (%) of GFP-positive tumor cells in bone marrow cells by flow cytometry and then counting the number of GFP-positive tumor cells ($\times 10^6$ cells) per mouse on the basis of this data, and shows the effects of various antibodies on bone metastasis (bone metastasis was suppressed). The middle graph of Part A (the number of CD45-negative cells in bone marrow) shows results of analyzing the percentage (%) of CD45− cells in bone marrow cells by flow cytometry and then counting the number of CD45-negative bone marrow cells ($\times 10^6$ cells) per mouse on the basis of this data, and shows the effects of various antibodies on MSC expansion in bone marrow (MSC expansion in bone marrow was suppressed). The right graph of Part A (mouse body weight) shows effects on weight change (although a mouse is emaciated by bone metastasis, this was found to be suppressed as a result of measuring the body weight as an index thereof). In the bar graphs of Part A, groups respectively receiving no treatment, a control antibody, clone #6-55, #7-34, and #8-1 are depicted from the upper to lower bars. Five graphs of Part B show the tumor volume of each mouse individual (one line represents one mouse) measured 7, 11, and 14 days after tumor implantation, and show the effects of various antibodies on tumor growth. Groups respectively receiving no treatment, a control antibody, clone #6-55, #7-34, and #8-1 are depicted from the left to the right. The numerical values within the parentheses and the numerical values on the lines (indicated by P) represent p values regarding statistical significance (day 14). The abscissa shows the number of days. The ordinate shows tumor volume (mm3). All of the 3 anti-FSTL1 antibodies to be tested significantly suppressed the growth of subcutaneous tumor with respect to the control antibody. In addition, an anti-weight loss effect was confirmed by the administration of #6-55 and #8-1.

1. Experiment group (n=5)
1. No treatment (0.9% NaCl as a sham)
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5 \times 10^5$ cells subcutaneously & $1 \times 10^5$ cells intravenously)
Day 5: intraperitoneal administration of the antibody (first dose, corresponding to 200 µg/mouse=10 mg/kg)
Day 10: intraperitoneal administration of the antibody (second dose, corresponding to 200 µg/mouse=10 mg/kg)
Day 14: various immunological assays
   The intraperitoneal administration and the intravenous administration are pharmacologically used interchangeably with systemic administration methods.
3. Index for drug efficacy evaluation
   Effects on the growth of subcutaneous tumor (calculation of tumor volume by tumor size measurement): measured 7, 11, and 14 days after tumor implantation (FIG. 42B)
   Effects on bone metastasis (GFP-positive tumor cells in bone marrow or the spleen) (FIGS. 42A and 42C)
   Effects on MSC expansion (CD45-negative cells in bone marrow or the spleen) (FIGS. 42A and 42C)
   Effects on weight loss (FIG. 42A)
   Effects on the expansion of immunosuppressive Treg cells (CD4-positive and Foxp3-positive cells in the spleen) (FIG. 42C)
   Other immunosuppressive properties (FIG. 42C)

DESCRIPTION

In Example 17, the antibody was administered into tumor according to the purpose of "inhibiting metastasis from a primary focus to bone" as previously conducted by the present inventors. In this Example, the conditions of Example 17 were changed, and intraperitoneal administration generally performed in mouse experiments was adopted in consideration of the fact that antibody drugs are systemically administered in general. All procedures except for the antibody administration method were performed in the same way as in Example 17 above. Specifically, antitumor effects and immunosuppression-mitigating effects were comparatively analyzed by the intraperitoneal administration (systemic administration) of the anti-FSTL1 antibody using bone metastasis models in which mouse melanoma cells (B16-F10) forced to express Snail were subcutaneously and intravenously transplanted in C57BL/6N mice.

Also, assays were conducted 14 days after tumor implantation. The antibody was intraperitoneally administered at 10 mg/kg twice (5 and 10 days after tumor implantation) to the mice.

(Results)

Figure 42B:
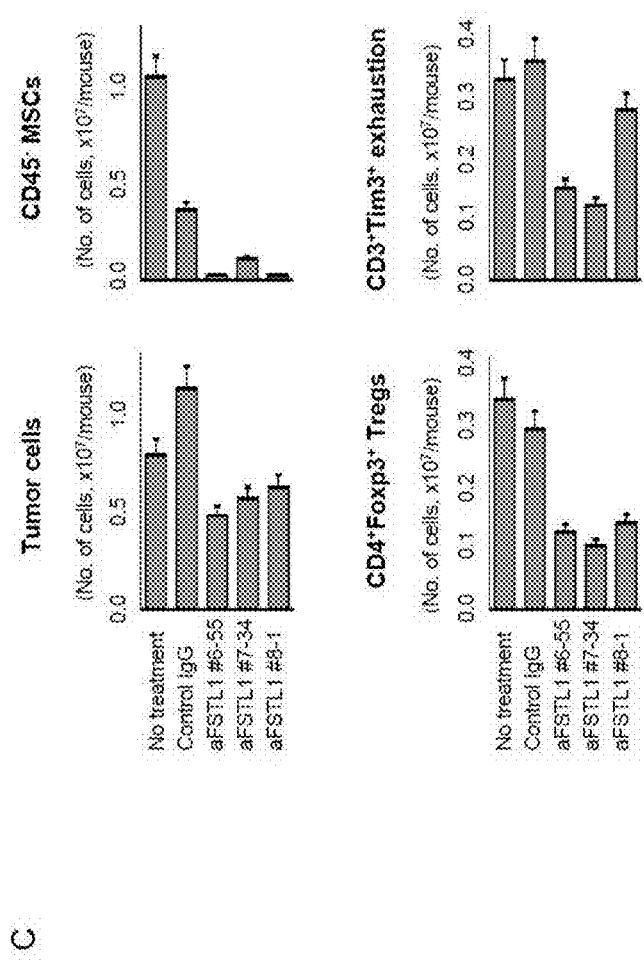
FIG. 42B also shows results of evaluating antibody activity in vivo (Example 18). This figure shows results of evaluating antibody activity in vivo and shows results of comparatively analyzing antitumor effects and immunosuppression-mitigating effects using bone metastasis models in which mouse melanoma cells (B16-F10) forced to express Snail were subcutaneously and intravenously transplanted in C57BL/6N mice. An anti-FSTL1 antibody to be tested was intraperitoneally administered (systemic administration). On day 0, GFP-positive and Snail-positive B16-F10 tumor cells ($5\times10^5$ cells subcutaneously & $1\times10^5$ cells intravenously) were transplanted. On day 5, the antibody was intraperitoneally administered (first dose, corresponding to 200 µg/mouse=10 mg/kg). On day 10, the antibody was intraperitoneally administered (second dose, corresponding to 200 µg/mouse=10 mg/kg). On day 14, various assays were conducted. Part C shows change in cell populations in the spleen. The upper left graph of Part C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

The results are shown in FIG. 42. Intraperitoneal administration was performed as a method for administering the anti-FSTL1 antibody to be tested here. In in vivo evaluation, as in Example 17, all of the 3 anti-FSTL1 antibodies significantly suppressed the growth of subcutaneous tumor with respect to the control antibody (FIG. 42B). In addition, an anti-weight loss effect (right graph of FIG. 42A) was confirmed by the administration of #6-55 and #8-1. In light of these functional analysis results, even decrease in the number of Tregs, which has heretofore received attention in terms of immunosuppression, or the removal of the Tregs is not sufficient treatment for cancer treatment. Instead, the control of the whole immunosuppression cascade should be contemplated. It is expected that the targeting of MSCs positioned most upstream thereof is more effective. It can also be reconfirmed that the inhibition of even cancer metastasis (middle graph of FIG. 42A) at the same time with decrease in the number of MSCs (left graph of FIG. 42A) is further effective. The possibility is expected that inhibitory treatment targeting FSTL1 is effective for cancer treatment. FIG. 42C shows change in cell populations in the spleen. The upper left graph of FIG. 42C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Example 19: In Vivo Antibody Activity Evaluation-Comparison with Existing Drug

In this Example, drug efficacy was compared between existing antibody drugs for mitigation of immunosuppression and the anti-FSTL1 antibody using bone metastasis models having a transplant of mouse melanoma B16-F10 cells forced to express Snail.

DESCRIPTION

Procedures and methods of the experiment were substantially the same as in Examples 17 and 18, and assays were conducted 15 days after tumor implantation.

An antibody given below was intraperitoneally administered as an existing drug at 10 mg/kg (200 µg/mouse) twice (4 and 8 days after tumor implantation) to the mice.

In this Example, therapeutic effects were comparatively studied using antibody drugs already clinically used for the purpose of "mitigation of immunosuppression", which is one mechanism of action of the anti-FSTL1 antibody, and Snail-positive tumor bone metastasis models. The antibody was systemically administered twice, as in the preceding test, according to general animal tests using antibody drugs.
1 Experiment group (n=5)
1 No treatment (0.9% NaCl as a sham)
2 Control IgG (anti-DNP)
3 Anti-FSTL1 mAb (#6-55)
4 Anti-CTLA4 mAb (Clone 9H10, BioLegend)
5 Anti-PD-1 mAb (Clone 29F.1A12, BioLegend)
6 Anti-PD-L1 mAb (Clone 10F.9G2, BioLegend)
7 Naive (no tumors, no treatment)
2 Experimental procedure
Day 0: transplantation of GFP-positive and Snail-positive B16-F10 tumor cells ($5 \times 10^5$ cells subcutaneously & $1 \times 10^5$ cells intravenously)
Day 4: intraperitoneal administration of the antibody (first dose, corresponding to 200 µg/mouse=10 mg/kg)
Day 8: intraperitoneal administration of the antibody (second dose, corresponding to 200 µg/mouse=10 mg/kg)
Day 15: various assays
3. Index for drug efficacy evaluation
   Effects on the growth of subcutaneous tumor (calculation of tumor volume by tumor size measurement): measured 8, 11, and 14 days after tumor implantation (FIG. 43A)
   Effects on bone metastasis (amount of GFP-positive tumor cells in bone marrow) (FIG. 43B)
   Effects on MSC expansion in bone marrow (FIG. 43B)
   Effects on weight loss (FIG. 43B)
(Results)

Figure 43:
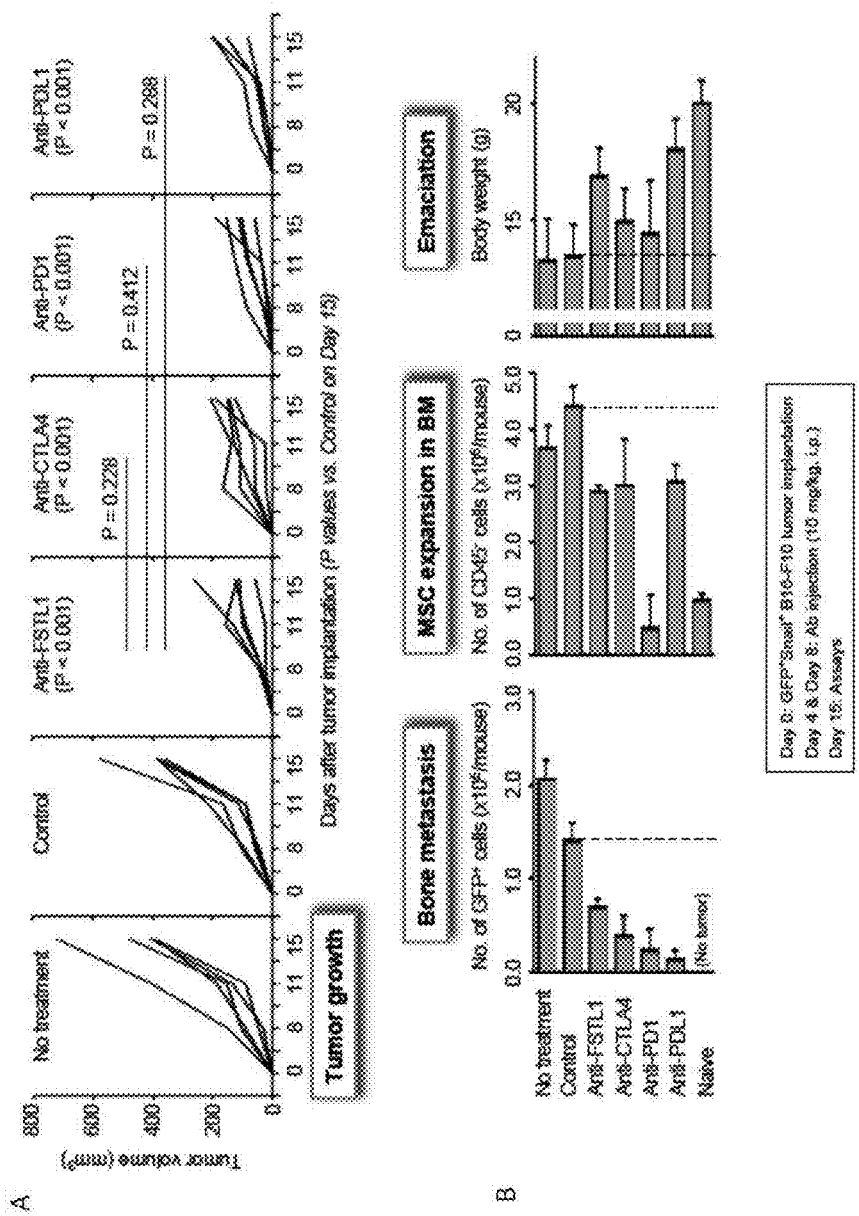
FIG. 43 also shows results of evaluating antibody activity in vivo (Example 19). This figure shows results of comparing drug efficacy between existing antibody drugs for mitigation of immunosuppression and an anti-FSTL1 antibody using bone metastasis models having a transplant of mouse melanoma B16-F10 cells forced to express Snail. Part A shows the effects of various antibodies on tumor volume over time. This figure shows the tumor volume of each mouse individual (one line represents one mouse) measured 8, 11, and 15 days after tumor implantation, and shows the effects of various antibodies on tumor growth. No treatment, a control antibody, an anti-FSTL1 antibody, an anti-CTLA4 antibody, an anti-PD-1 antibody, and an anti-PD-L1 antibody are depicted from the left to the right. The numerical values within the parentheses and the numerical values on the lines (indicated by P) represent p values regarding statistical significance (day 15). The abscissa shows the number of days. The ordinate shows tumor volume ($mm^3$). On day 0, GFP-positive and Snail-positive B16-F10 tumor cells were transplanted ($5\times10^5$ cells subcutaneously & $1\times10^5$ cells intravenously). On day 4, the antibody was intraperitoneally administered (first dose, corresponding to 200 µg/mouse=10 mg/kg). On day 8, the antibody was intraperitoneally administered (second dose, corresponding to 200 µg/mouse=10 mg/kg). On day 15, various assays were conducted. The left graph of Part B shows effects on bone metastasis (the number of GFP-positive cells ($10^6$/mouse)). The middle graph of FIG. 43B shows effects on MSC expansion in bone marrow (the number of CD45-negative cells (($10^6$/mouse)). The right graph of Part B shows effects on weight change (body weight (g)). All of the graphs of Part B depict no treatment, a control antibody, an anti-FSTL1 antibody, an anti-CTLA4 antibody, an anti-PD-1 antibody, and an anti-PD-L1 antibody from the upper to lower bars. The following existing antibody drugs were used as control antibodies: Anti-CTLA4 mAb (clone 9H10, BioLegend, Inc.); Anti-PD-1 mAb (clone 29F.1A12, BioLegend, Inc.); and Anti-PD-L1 mAb (clone 10F.9G2, BioLegend, Inc.). In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

The results are shown in FIG. 43. In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Example 20: In Vivo Antibody Activity Evaluation-Colorectal Cancer Model

In this Example, the drug efficacy of the anti-FSTL1 antibody was evaluated using mouse colorectal cancer CT26 cell-transplanted models.

Procedures and methods of the experiment were basically performed under substantially the same conditions as in the bone metastasis model experiments of Examples 17 to 19 except that bone metastasis was not evaluated. Specifically, drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The test was conducted by changing only the amount of tumor implanted, antibody administration timing, and assay timing.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth (FIG. 44A) and lung metastasis (FIG. 44B))

For lung metastasis, the number of metastatic nodules in the lung was macroscopically counted. The tumor volumes of the mice were measured 7, 11, and 14 days after tumor implantation.

(Results)

Figures 44A, 44B:
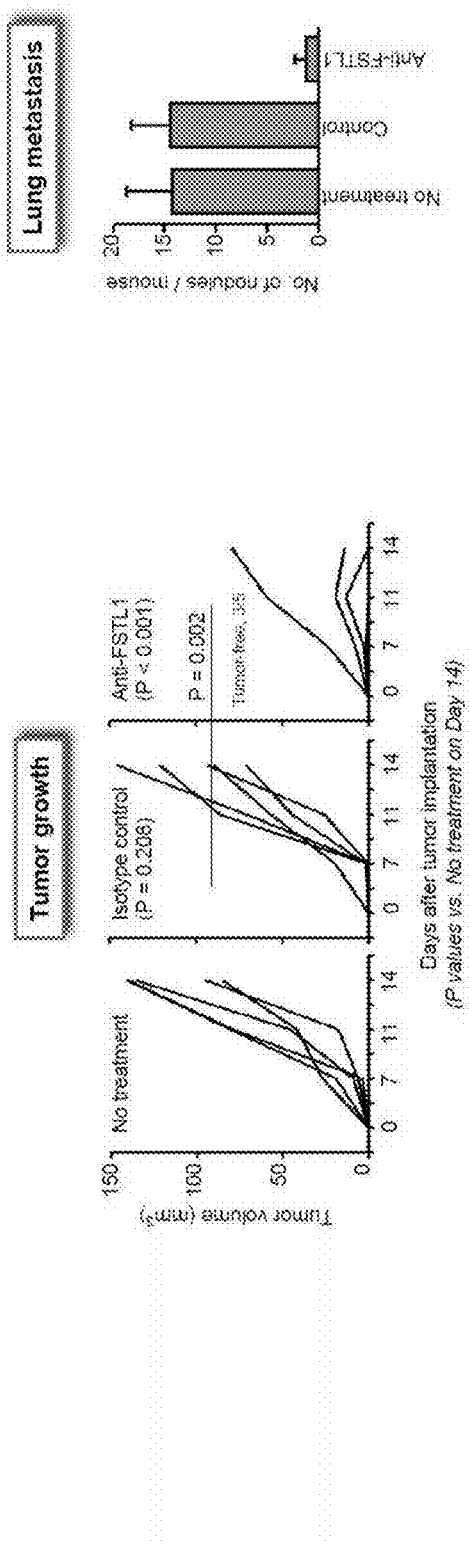
FIG. 44 also shows results of evaluating antibody activity in vivo (Example 20). This figure shows results of evaluating the drug efficacy of an anti-FSTL1 antibody using mouse colorectal cancer CT26 cell-transplanted models. All of the 3 graphs of Part A show effects on tumor growth. This figure shows the tumor volume of each mouse individual (one line represents one mouse) measured 7, 11, and 14 days after tumor implantation, and shows the effects of various antibodies on tumor growth. The left graph depicts no treatment, the middle graph depicts a control antibody (anti-DNP antibody), and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume ($mm^3$). Drug efficacy evaluation was conducted using mouse tumor models other than Snail+ tumor bone metastasis models. In this Example, the drug efficacy of the anti-FSTL1 antibody was evaluated using cancer-bearing models of BALB/c mice different in strain from the C57BL/6 mice used in the preceding tests. Part B shows results about the number of metastatic nodules in the lung. The left bar depicts no treatment, the middle bar depicts a control antibody (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

The results are shown in FIG. 44. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The results about the number of metastatic nodules in the lung are shown in FIG. 44B. The left bar depicts no treatment, the middle bar depicts an isotype control (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

Example 21: In Vivo Antibody Activity Evaluation-Breast Cancer Model

In this Example, the drug efficacy of the anti-FSTL1 antibody was evaluated using mouse breast cancer 4T1 cell-transplanted models.

Procedures and methods of the experiment were basically performed according to Examples 17 to 20 under substantially the same conditions as in the bone metastasis model experiments of Examples 17 to 20. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. Changes were made as follows.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth)

The tumor volumes of the mice were measured 4, 7, 11, and 14 days after tumor implantation.
(Results)

Figure 45:
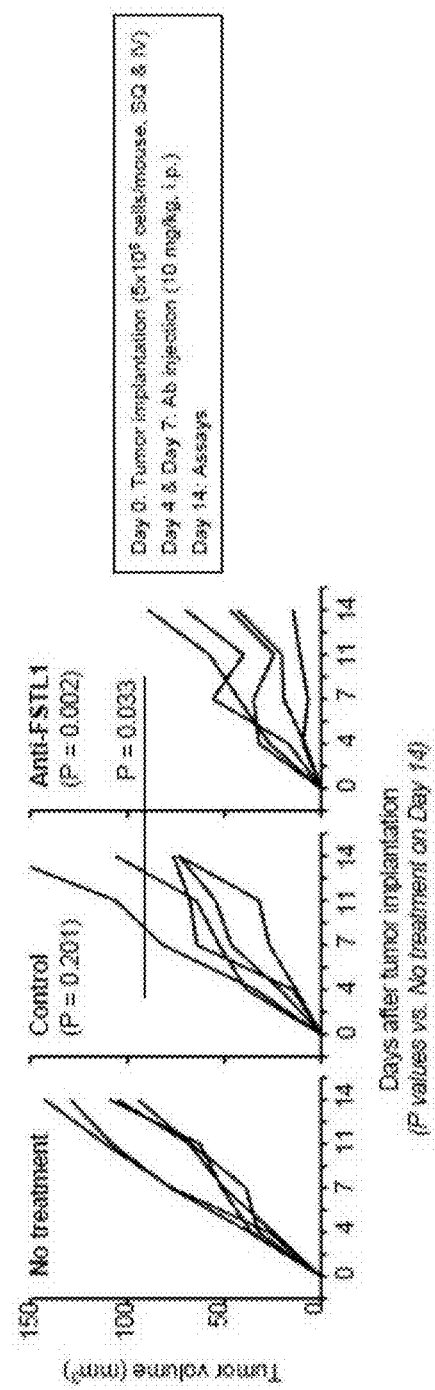
FIG. 45 also shows results of evaluating antibody activity in vivo (Example 21). This figure shows results of evaluating the drug efficacy of an anti-FSTL1 antibody using mouse breast cancer 4T1 cell-transplanted models. All of the 3 graphs show effects on tumor growth. This figure shows the tumor volume of each mouse individual (one line represents one mouse) measured 4, 7, 11, and 14 days after tumor implantation, and shows the effects of various antibodies on tumor growth. The left graph depicts no treatment, the middle graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume ($mm^3$). On day 0, tumor cells were transplanted ($5\times10^5$ cells subcutaneously & $5\times10^5$ cells intravenously). On days 4 and 7, the antibody was intraperitoneally administered (10 mg/kg). On day 14, drug efficacy evaluation (subcutaneous tumor growth) was conducted. The drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The growth of 4T1 subcutaneous tumor was able to be significantly suppressed by the administration of the anti-FSTL1 antibody (#6-55).

The results are shown in FIG. 45. The growth of 4T1 subcutaneous tumor was able to be significantly suppressed by the administration of the anti-FSTL1 antibody (#6-55).

Example 22: In Vivo Antibody Activity Evaluation-Melanoma B16-10

In this Example, the drug efficacy of the anti-FSTL1 antibody was evaluated using mouse melanoma B16-F10.

The drug efficacy of the anti-FSTL1 antibody was evaluated according to Examples 17 to 20 using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests.

1. Experiment group (n=5)
  1. Mouse melanoma B16-F10+control IgG (anti-DNP mAb)
  2. Mouse melanoma B16-F10+anti-FSTL1 mAb (#6-55)
2. Experimental procedure
Day 0: transplantation of tumor cells ($1 \times 10^6$ cells subcutaneously & $1 \times 10^6$ cells intravenously)
Day 3: intraperitoneal administration of the antibody (first dose, corresponding to 200 µg/mouse=10 mg/kg)
Day 6: intraperitoneal administration of the antibody (second dose, corresponding to 200 µg/mouse=10 mg/kg)
Day 15 various immunological assays
3. Index for drug efficacy evaluation
  Effects on the growth of subcutaneous tumor (calculation of tumor volume by tumor size measurement): measured 6, 10, and 14 days after tumor implantation (FIG. 46A)
  Effects on weight loss (FIG. 46B)
(Results)

Figure 46:
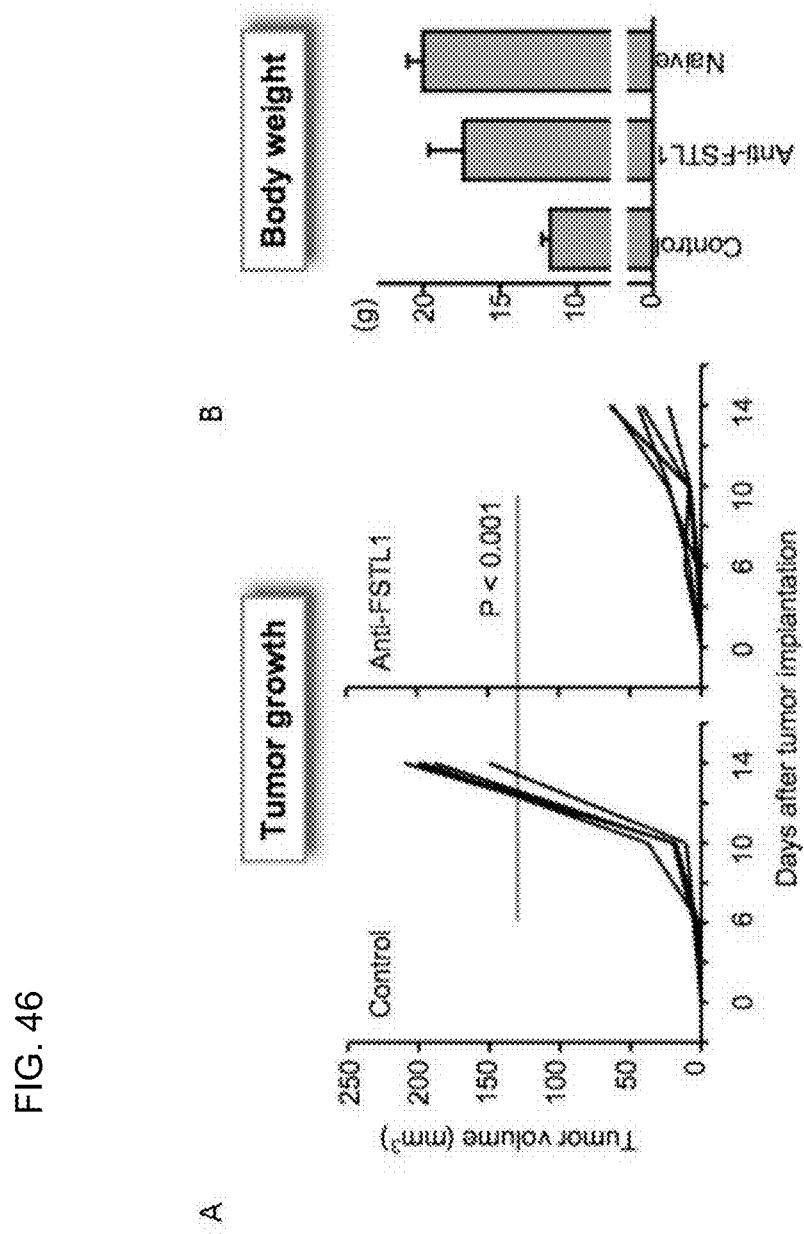
FIG. 46 Part A also shows results of evaluating antibody activity in vivo (Example 22). This figure shows results of evaluating the drug efficacy of an anti-FSTL1 antibody using mouse melanoma B16-F10. Both two graphs of the left panel show effects on tumor growth. This figure shows the tumor volume of each mouse individual (one line represents one mouse) measured 6, 10, and 14 days after tumor implantation, and shows the effects of various antibodies on tumor growth. The left graph depicts a control antibody, and the right graph depicts the anti-FSTL1 antibody (#6-55). The numerical values within the parentheses and the numerical values on the lines (indicated by P) represent p values regarding statistical significance (day 14). The abscissa shows the number of days. The ordinate shows tumor volume ($mm^3$). Part B shows effects on weight change. The left bar depicts a control antibody, the middle bar depicts the anti-FSTL1 antibody, and the right bar depicts an untreated individual that received no tumor cell. The ordinate shows tumor volume (g). The drug efficacy of the anti-FSTL1 antibody was evaluated using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests. Subcutaneous tumor growth was strongly suppressed by the administration of the anti-FSTL1 antibody (#6-55), as compared with the control antibody administration group. Also, suppressive activity against weight loss was also exhibited.

The results are shown in FIG. 46. Subcutaneous tumor growth was strongly suppressed by the administration of the anti-FSTL1 antibody (#6-55), as compared with the control antibody administration group. In the anti-FSTL1 antibody administration group, suppressive activity against weight loss was also exhibited (FIG. 46A), and neither remarkable emaciation nor fluffing, etc. was observed (FIG. 46B). Thus, all of the mice were fine. In this model, lung metastasis is usually observed 20 to 30 days after implantation. This evaluation was conducted approximately 2 weeks after implantation according to the timing in the preceding tests. Therefore, no metastatic nodule in the lung was macroscopically observed.

Example 23: In Vivo Antibody Activity Evaluation-Lymphoma

In this Example, the drug efficacy of the anti-FSTL1 antibody was evaluated using mouse lymphoma EL4.

The drug efficacy of the anti-FSTL1 antibody was evaluated according to Examples 17 to 20 using mouse lymphoma EL4, which is a cancer type having enhanced FSTL1 expression.
1. Experiment group (n=5)
  1. Mouse lymphoma EL4+control IgG (anti-DNP mAb)
  2. Mouse lymphoma EL4+anti-FSTL1 mAb (#6-55)
2. Experimental procedure
Day 0: transplantation of tumor cells ($1 \times 10^6$ cells subcutaneously & $1 \times 10^6$ cells intravenously)
Day 3: intraperitoneal administration of the antibody (first dose, corresponding to 200 µg/mouse=10 mg/kg)
Day 6: intraperitoneal administration of the antibody (second dose, corresponding to 200 µg/mouse=10 mg/kg)
Day 15: various immunological assays
3. Index for drug efficacy evaluation
  Effects on the growth of subcutaneous tumor (calculation of tumor volume by tumor size measurement): measured 3, 6, and 10 days after tumor implantation
(Results)

Figure 47:
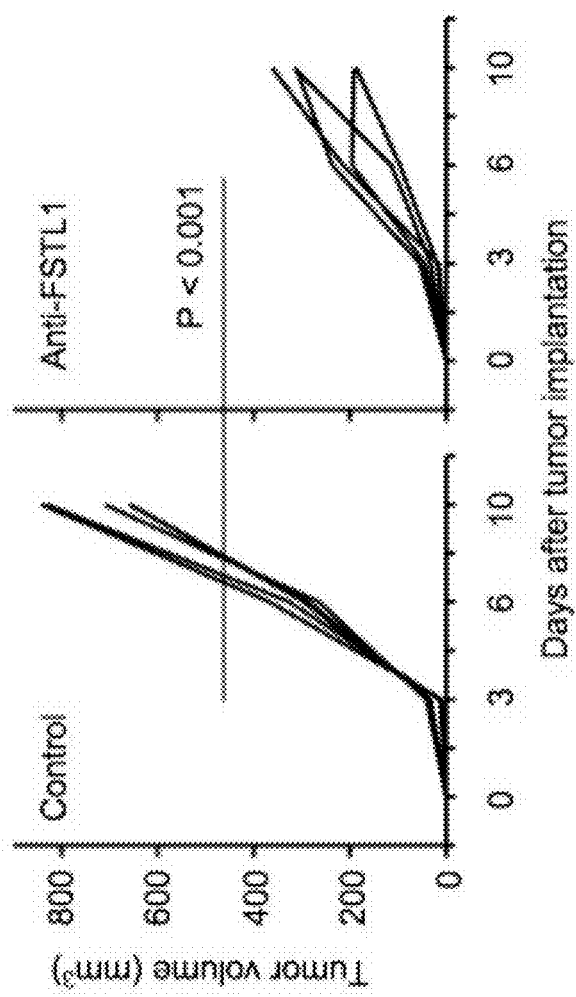
FIG. 47 also shows results of evaluating antibody activity in vivo (Example 23). This figure shows results of evaluating the drug efficacy of an anti-FSTL1 antibody using mouse lymphoma EL4. Both two graphs show effects on tumor growth. This figure shows the tumor volume of each mouse individual (one line represents one mouse) measured 3, 6, and 10 days after tumor implantation, and shows the effects of various antibodies on tumor growth. The left graph depicts a control antibody, and the right graph depicts the anti-FSTL1 antibody. The numerical values within the parentheses and the numerical values on the lines (indicated by P) represent p values regarding statistical significance (day 14). The abscissa shows the number of days. The ordinate shows tumor volume ($mm^3$). The drug efficacy of the anti-FSTL1 antibody was evaluated using mouse lymphoma EL4, which is a cancer type having enhanced FSTL1 expression. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group.

The results are shown in FIG. 47. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group. It can be concluded that the proven effectiveness for lymphoma, one highly FSTL1-expressing cancer type comparable to breast cancer, is very useful data for developing clinical trials.

Figure 48:
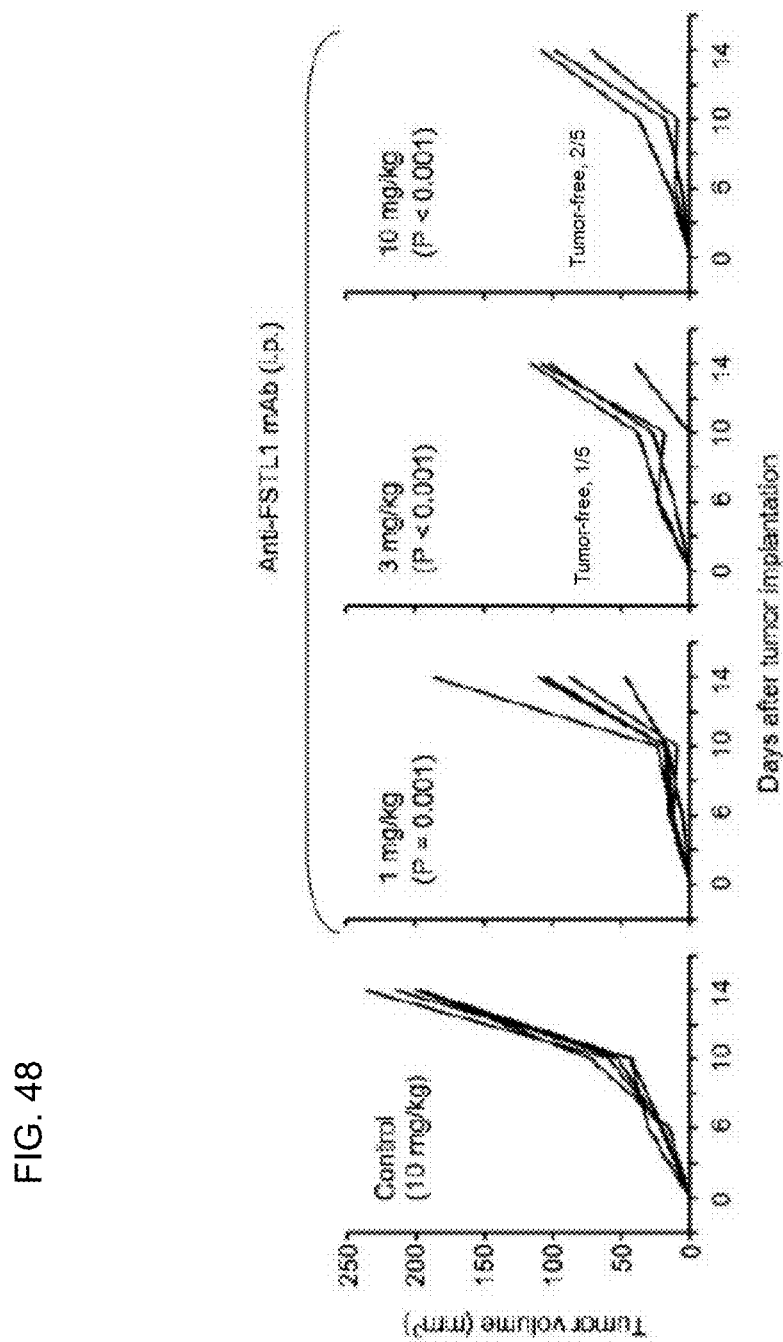
FIG. 48 also shows results of evaluating antibody activity in vivo (Example 24). This figure shows results of evaluating the drug efficacy of an anti-FSTL1 antibody using mouse melanoma B16-F10. All of the 4 graphs show effects on tumor growth. This figure shows the tumor volume of each mouse individual (one line represents one mouse) measured 6, 10, and 14 days after tumor implantation, and shows the effects of various antibodies on tumor growth. The leftmost graph depicts a control antibody, the second graph from the left depicts 1 mg/kg of the anti-FSTL1 antibody, the second graph from the right depicts 3 mg/kg of the anti-FSTL1 antibody, and the rightmost graph depicts 10 mg/kg of the anti-FSTL1 antibody. The numerical values within the parentheses and the numerical values on the lines (indicated by P) represent p values regarding statistical significance (day 14). The abscissa shows the number of days. The ordinate shows tumor volume ($mm^3$). The drug efficacy of the anti-FSTL1 antibody was evaluated in the same test system as in the experiment illustrated in FIG. 46 except that only subcutaneous transplantation was performed here in order to more clearly evaluate reactivity. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Example 24: In Vivo Antibody Activity Evaluation-Melanoma B16-10, Subcutaneous Transplantation In this Example, the drug efficacy of the anti-FSTL1 antibody was evaluated using mouse melanoma B16-F10. The drug efficacy of the anti-FSTL1 antibody was evaluated in the same test system as in Example 22 according to Examples 17 to 20 except that only subcutaneous transplantation was performed here in order to more clearly evaluate reactivity.
1. Experiment group (n=5)
1. Control IgG (anti-DNP), 10 mg/kg
2. Anti-FSTL1 mAb (#6-55), 1 mg/kg
3. Anti-FSTL1 mAb (#6-55), 3 mg/kg
4. Anti-FSTL1 mAb (#6-55), 10 mg/kg
2. Experimental procedure
Day 0: subcutaneous transplantation of mouse melanoma B16-F10 cells ($1\times10^6$ cells)
Day 4: intraperitoneal administration of the antibody (first dose)
Day 8: intraperitoneal administration of the antibody (second dose)
Day 15: various immunological assays
3. Index for drug efficacy evaluation
Effects on the growth of subcutaneous tumor (calculation of tumor volume by tumor size measurement): measured 6, 10, and 14 days after tumor implantation
(Results)
The results are shown in FIG. 48. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Example 25: In Vivo Effect of Combination Therapy

In this Example, drug efficacy was evaluated in the combination therapy of the anti-FSTL1 antibody and an existing drug.
Whether or not combined use with an antibody drug for mitigation of immunosuppression could enhance the drug efficacy of the anti-FSTL1 antibody was studied using Snail+ tumor bone metastasis models.
Experiment group (n=5)
1. Control IgG (Anti-DNP mAb)
2. Anti-FSTL1 mAb (Clone 6-55), 5 mg/kg
3. Anti-FSTL1 mAb (Clone 6-55), 10 mg/kg
4. Anti-FSTL1 mAb (Clone 6-55)+Anti-CTLA4 mAb (Clone 9H10, BioLegend), 5 mg/kg each
5. Anti-FSTL1 mAb (Clone 6-55)+Anti-PD1 mAb (Clone 29F.1A12, BioLegend), 5 mg/kg each
6. Anti-FSTL1 mAb (Clone 6-55)+Anti-PD-L1 mAb (Clone 10F.9G2, BioLegend), 5 mg/kg each
7. Naive (no tumors, no treatment)
2. Experimental procedure
Day 0: transplantation of GFP+ Snail+B16-F10 tumor cells ($5\times10^5$ cells subcutaneously & $1\times10^5$ cells intravenously)
Day 3: intraperitoneal administration of the antibody (first dose)
Day 7: intraperitoneal administration of the antibody (second dose)
Day 13: various assays
3. Index for drug efficacy evaluation
Effects on the growth of subcutaneous tumor (calculation of tumor volume by tumor size measurement)
Effects on bone metastasis (amount of GFP+ tumor cells in bone marrow)
Effects on mouse weight loss
Effects on MSC expansion in bone marrow
(Results)
The results are shown in FIG. 48. The anti-FSTL1 antibody was effective even at the half-dose 5 mg/kg used in the preceding tests, and exhibited a significant suppressive effect, as compared with the control antibody group, on all of the tested items such as the growth and bone metastasis of subcutaneous tumor, MSC growth, and mouse weight loss.

Three antibody drugs for mitigation of immunosuppression were each administered at the same time with this 5 mg/kg of the anti-FSTL1 antibody. As a result, only in the case of combined use with the anti-PD-L1 antibody, the antitumor effect of the anti-FSTL1 antibody was enhanced, and subcutaneous tumor disappeared in two out of the five mice.

In the case of administering the double-dose 10 mg/kg of the anti-FSTL1 antibody as a single agent, strong drug efficacy substantially equivalent to that of combined administration with the anti-PD-L1 antibody was also observed. However, the combined use with the anti-PD-L1 antibody was superior in suppressive effect on subcutaneous tumor growth.

In the combined use with the anti-CTLA4 antibody or the anti-PD1 antibody, no synergistic effect was confirmed. Rather, the drug efficacy of the anti-FSTL1 antibody was canceled, and neither bone metastasis nor MSC expansion was able to be strongly suppressed. It appears that these antibodies tend to enhance bone metastasis.

As in the anti-FSTL1 antibody single agent administration group or the anti-PD-L1 antibody combined administration group in which a strong antitumor effect was seen, the expansion of CD4+ Foxp3+ Treg cells in tumor was significantly suppressed by the combined use with the anti-CTLA4 antibody, and the expansion of CD11b+Gr1+ MDSC cells was significantly suppressed by the combined use with the anti-PD1 antibody. In spite of this, CD8+T cells capable of attacking cancer hardly invaded tumor. This suggests that rather than decrease in the numbers of Tregs or MDSCs which have previously received attention, decrease in the number of MSCs positioned upstream thereof is important for correctly inducing CTL in the first place.

Example 26-1: Treg Induction Inhibitory Activity of Anti-FSTL1 Antibody Using Human Peripheral Blood Cell In this Example, the Treg induction inhibitory activity of the anti-FSTL1 antibody was evaluated using human peripheral blood cells.
Human peripheral blood cells ($1\times10^6$ cells) were stimulated using FSTL1 (5 ng/ml), supplemented with the antibody (5 µg/mL), and cultured for 3 days. The percentage of a $Foxp3^+CTLA4^+$ cell fraction (Exp. 1) or a $CD4^+Foxp3^+CTLA4^+$ cell fraction (Exp. 2) in $CD4^+$ T cells was analyzed as Treg cells by flow cytometry. The flow cytometry conditions are as follows.

Blood was collected from a healthy person by the addition of a 1/10 amount of 4% sodium citrate, then layered on Ficoll (specific gravity: 1.090), and centrifuged (1500 rpm, 20 min, room temperature), and a cell fraction present in an intermediate layer was used as "PBMCs". The antibody (5 µg/mL) was added to a system in which these PBMCs ($1 \times 10^6$ cells) were cultured for 3 days under stimulation with FSTL1 (5 ng/ml) in a 24-well plate. PBMCs recovered from the culture system were incubated at 4° C. for 1 hour using an anti-CD4 antibody (BD Pharmingen/Becton, Dickinson and Company), an anti-CD25 antibody (BD Pharmingen/Becton, Dickinson and Company), and an anti-FoxP3 antibody (eBioscience). Then, the percentage of a Foxp3+ CTLA4+ cell fraction (Exp. 1) or a CD4+Foxp3+CTLA4+ cell fraction (Exp. 2) in CD4+ T cells contained therein was analyzed as Treg cells using a flow cytometer FACScan (Becton, Dickinson and Company).

Figure 49A:
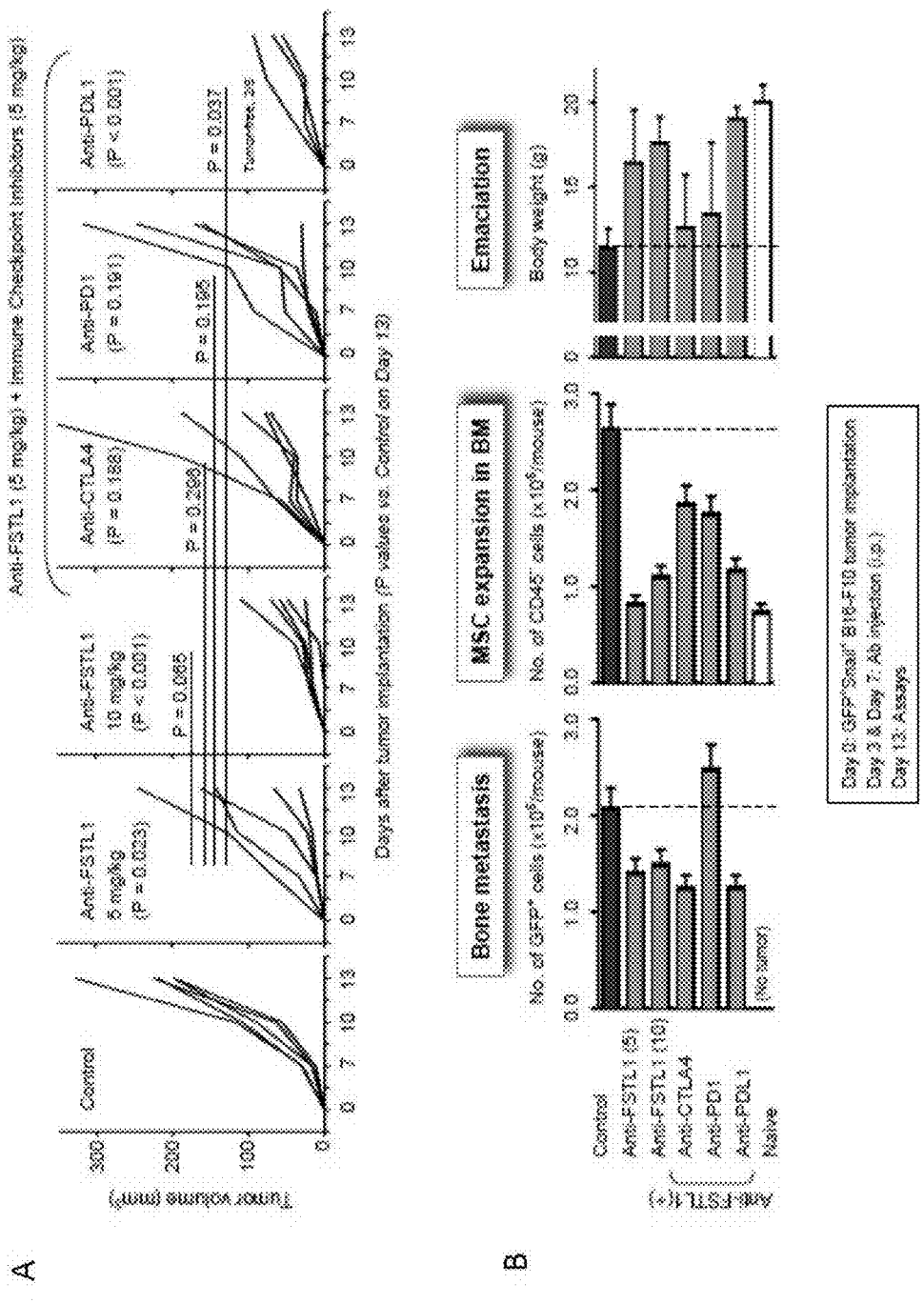
FIG. 49A shows the in vivo effects of combination therapy. This figure shows results of evaluating drug efficacy in the combination therapy of an anti-FSTL1 antibody and an existing drug (Example 25). The 6 graphs of the upper panel show the effects of various antibodies on tumor volume over time. A control, the anti-FSTL1 antibody (half-dose 5 mg/kg), the anti-FSTL1 antibody (full-dose 10 mg/kg), a combination of the anti-FSTL1 antibody (half-dose 5 mg/kg) and an anti-CTLA4 antibody (half-dose 5 mg/kg), a combination of the anti-FSTL1 antibody (half-dose 5 mg/kg) and an anti-PD1 antibody (half-dose 5 mg/kg), and a combination of the anti-FSTL1 antibody (half-dose 5 mg/kg) and an anti-PD-L1 antibody (half-dose 5 mg/kg) are depicted from the left to the right. The numerical values within the parentheses and the numerical values on the lines (indicated by P) represent p values regarding statistical significance (day 13). On day 0, GFP+ Snail+B16-F10 tumor cells were transplanted ($5 \times 10^5$ cells subcutaneously & $1 \times 10^5$ cells intravenously). Antibody administration was performed on days 3 and 7, and assays were conducted on day 13. Each line shows change in the tumor volume of each individual (tumor volume ($mm^3$)). The abscissa shows the number of days. The ordinate shows tumor volume ($mm^3$). The lower left diagram shows effects on bone metastasis (the number of GFP-positive cells ($10^6$/mouse)). The lower middle diagram shows effects on MSC expansion in bone marrow (the number of CD45-negative cells (($10^6$/mouse)). The lower right diagram shows effects on weight change (body weight (g)). All of the graphs of the lower panel depict a control, the anti-FSTL1 antibody (half-dose 5 mg/kg), the anti-FSTL1 antibody (full-dose 10 mg/kg), a combination of the anti-FSTL1 antibody (half-dose 5 mg/kg) and an anti-CTLA4 antibody (half-dose 5 mg/kg), a combination of the anti-FSTL1 antibody (half-dose 5 mg/kg) and an anti-PD1 antibody (half-dose 5 mg/kg), a combination of the anti-FSTL1 antibody (half-dose 5 mg/kg) and an anti-PD-L1 antibody (half-dose 5 mg/kg), and naive from the upper to lower bars. Whether or not combined use with an antibody drug for mitigation of immunosuppression could enhance the drug efficacy of the anti-FSTL1 antibody was studied using Snail+ tumor bone metastasis models. The anti-FSTL1 antibody was effective even at the half-dose 5 mg/kg used in the preceding tests, and exhibited a significant suppressive effect, as compared with the control antibody group, on all of the tested items such as the growth and bone metastasis of subcutaneous tumor, MSC growth, and mouse weight loss. Three antibody drugs for mitigation of immunosuppression were each administered at the same time with this 5 mg/kg of the anti-FSTL1 antibody. As a result, only in the case of combined use with the anti-PD-L1 antibody, the antitumor effect of the anti-FSTL1 antibody was enhanced, and subcutaneous tumor disappeared in two out of the five mice. In the case of administering the double-dose 10 mg/kg of the anti-FSTL1 antibody as a single agent, strong drug efficacy substantially equivalent to that of combined administration with the anti-PD-L1 antibody was also observed. However, the combined use with the anti-PD-L1 antibody was superior in suppressive effect on subcutaneous tumor growth. In the combined use with the anti-CTLA4 antibody or the anti-PD1 antibody, no synergistic effect was confirmed. Rather, the drug efficacy of the anti-FSTL1 antibody was canceled, and neither bone metastasis nor MSC expansion was able to be strongly suppressed.
Figure 49B:
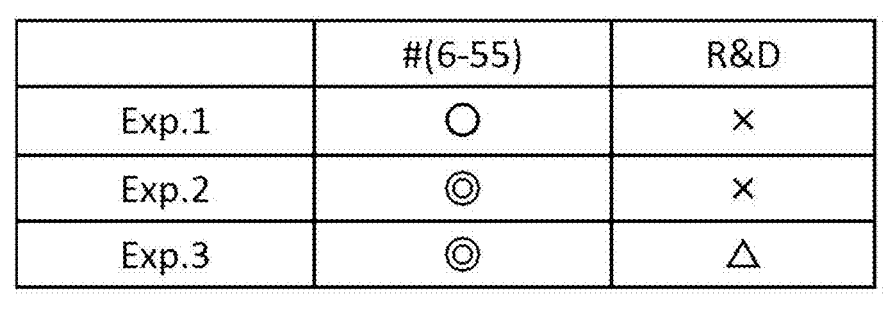

FIG. 49B summarizes these data and results in a table. The double circle, the circle, and the triangle depict statistical significance and represent 30% or more decrease, 10% to 30% decrease, and less than 10% decrease, respectively. The cross mark represents the absence of statistically significant difference. The results revealed that Tregs remarkably increase in number by stimulation with FSTL1, as with TGFb, etc., and this is significantly suppressed by the addition of antibody #6-55 of the present invention (the difference of Exp. 1 from Exp. 2 or 3 is based on difference in peripheral blood donor). On the other hand, a known antibody R&D antibody (R&D Systems, Inc., Cat. No. MAB1694, clone 229007) hardly exhibited inhibition. Here, the superiority of antibody #6-55 of the present invention was also confirmed again. These results indicated that antibody #6-55 of the present invention can remarkably inhibit Treg induction caused by FSTL1.

Example 26-2: Influence of Anti-FSTL1 Antibody on Proliferative Capacity and Invasive Capacity of Various Human Tumor Cells, Etc.

In this Example, the influence of the anti-FSTL1 antibody on the proliferative capacity and invasive capacity of various human tumor cells, the action of the anti-FSTL1 antibody under FSTL1 stimulation, and the action of the anti-FSTL1 antibody on cells forced to express Snail were examined.

Figure 50:
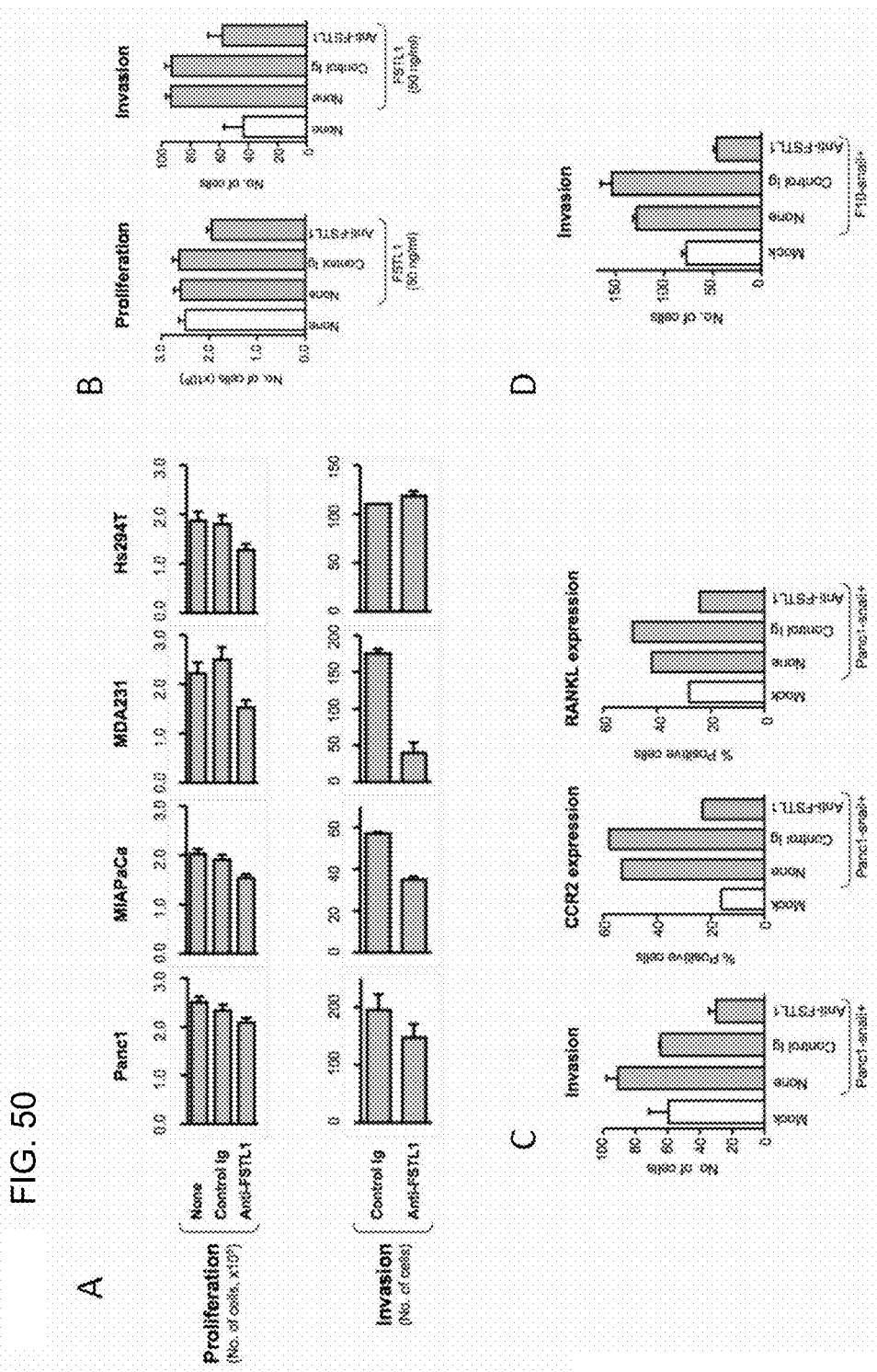
FIG. 50 shows results of examining various functions of an anti-FSTL1 antibody. Panel A shows the influence of the anti-FSTL1 antibody on the proliferative capacity and invasive capacity of various human tumor cells. The upper graphs of panel A show the results about proliferation, and the lower graphs show the results about invasion. Panc1, MIAPaCa, MDA231, and Hs294 are depicted from the left to the right. The upper graphs show the number of cells ($\times 10^3$) after culture for 3 days. The lower graphs show the number of tumor cells treated with the antibody for 3 days. In each of the upper graphs, none, control IgG, and the anti-FSTL1 antibody are depicted from the upper to lower bars. In each of the lower graphs, the upper bar depicts control IgG, and the lower bar depicts the anti-FSTL1 antibody. These results demonstrated that Snail+ tumor cells have very high metastatic properties. Panel B shows the action of the anti-FSTL1 antibody under FSTL1 stimulation. The left graph shows proliferative capacity, and the right graph shows invasive capacity. In both graphs, the left bar depicts none, and the second to fourth bars from the left depict none, mouse IgG, and the anti-FSTL1 antibody (#6-55) in order in the presence of FSTL1 (50 ng/ml). Panels C and D show the action of the anti-FSTL1 antibody on cells forced to express Snail. Panel C shows the results about Matrigel invasion, CCR2 expression, and RANKL expression from the left to the right. In all of the graphs, the left bar depicts Panc1 cells of a parent line that were not forced to express Snail (Mock), and the second bar from the left to the rightmost bar depict none, mouse IgG, and the anti-FSTL1 antibody (#6-55) in order in the presence of the anti-FSTL1 antibody (50 ng/ml). Panel D shows results obtained in Snail transfectants of mouse melanoma B16t-F10. In the graph, the left bar depicts a false antibody (Mock), and the second bar from the left to the rightmost bar depict none, mouse IgG, and the anti-FSTL1 antibody (#6-55) in order in the presence of FSTL1 (50 ng/ml).

Specifically, the influence of the anti-FSTL1 antibody on proliferative capacity and invasive capacity was studied using various human tumor cells, regardless of the presence or absence of the expression of Snail or FSTL1. Specifically, the anti-FSTL1 antibody (#6-55, 5 µg/ml) or a control antibody (aHema: mouse chimeric anti-hemagglutinin antibody, 5 µg/ml) was added to systems in which a pancreatic cancer cell line Panc1 (ATCC # CRL-1469), Panc1-snail+ which is a Panc1 cell line forced to express Snail, a pancreatic cancer cell line MIAPaCa (ATCC # CRL-1420), a bone metastatic breast cancer cell line MDA231 (ATCC # HTB-26), and a melanoma cell line Hs294T (ATCC # HTB-140) were each cultured at $1 \times 10^5$ cells. After culture for 3 days, the number of cells per culture system was counted to evaluate the proliferative capacity of the cells. The cells ($5 \times 10^4$ cells) after the counting were further inoculated to Matrigel-coated transwell chamber (Corning Inc. #354480) and cultured for 4 hours. Then, the membranes were removed, and stained and fixed with Crystal Violet fixative. Then, the number of cells that permeated the membranes was counted under a microscope to evaluate the invasive capacity of the cells. As a result, both proliferative capacity and invasive capacity were strongly suppressed, particularly, in a highly metastatic tumor cell line highly expressing Snail. This indicated that the anti-FSTL1 antibody acts particularly on tumor cells highly expressing FSTL1 and having EMT (FIG. 50A).

(Action of Anti-FSTL1 Antibody Under FSTL1 Stimulation)

Next, in order to examine how surrounding tumor cells were changed in a cancer microenvironment by receiving FSTL1 produced by Snail/FSTL1-expressing cells, and how the anti-FSTL1 antibody acts thereon, a human pancreatic cancer cell line Panc1 confirmed to express Snail or FSTL1 only slightly was stimulated with FSTL1 for 3 days. The anti-FSTL1 antibody (#6-55, 5 µg/ml) or a control antibody (aHema, 5 µg/ml) was added to this culture system, and subsequent change in cell function was analyzed in the same way as in the preceding paragraph. As a result, as previously reported in the paper (Cancer Res; 73 (20); 6185-93, 2013), FSTL1 had little influence or contribution on or to tumor growth, whereas the cell growth was reduced by the addition of the anti-FSTL1 antibody together with FSTL1. The paper also reports that FSTL1 enhances invasive capacity. It was revealed that the action thereof is canceled (FIG. 50B).

(Action of Anti-FSTL1 Antibody on Cell Forced to Express Snail)

Cell invasion was evaluated in the presence of the anti-FSTL1 antibody (#6-55, 5 µg/ml) or a control antibody (aHema, 5 µg/ml) in a chamber using Panc1-snail+, a cell line forced to express Snail, instead of the FSTL1-stimulated tumor cells of the preceding paragraph. The results are very similar to the results of the preceding paragraph, and suppressive activity was able to be confirmed in 6-55 (FIG. 50C)).

In this Example, Panc1-snail+ cells were cultured for 3 days in the presence of the added antibody. Then, the expression of CCR2 and RANKL among molecules known as bone metastasis markers was analyzed by flow cytometry. As a result, both CCR2 and RANKL were strongly suppressed by the anti-FSTL1 antibody. The anti-FSTL1 antibody presumably has inhibitory activity against cell invasion (FIG. 50D).

Example 27: MSC Induction Inhibition Test Using Mouse Bone Marrow Cell

In this Example, the inhibitory activity of the anti-FSTL1 antibody was confirmed in an experimental system of mesenchymal stem cell induction while a FSTL1 inhibitory effect on MSC expansion induced not only by FSTL1 but by Snail+ tumor cells was also evaluated. For specific operation, each antibody (10 µg/mL) was added to systems in which C57/BL/6 mouse-derived bone marrow cells were stimulated with FSTL1 (20 ng/mL) or a culture supernatant of tumor cells. After culture for 8 days under stimulation, cell fraction CD45(−) cells (MSCs) containing MSCs at a high rate and CD45(−)CD146(+)ALCAM(+) cells (sMSCs) increasing in number in association with cancer metastasis were analyzed by flow cytometry in the same way as in Example 14, and the number of cells per culture system was counted. In this Example, mouse immunoglobulin manufactured by BioLegend, Inc. (#401408, Cone MG1-45) was used as a control antibody.

Figure 51:
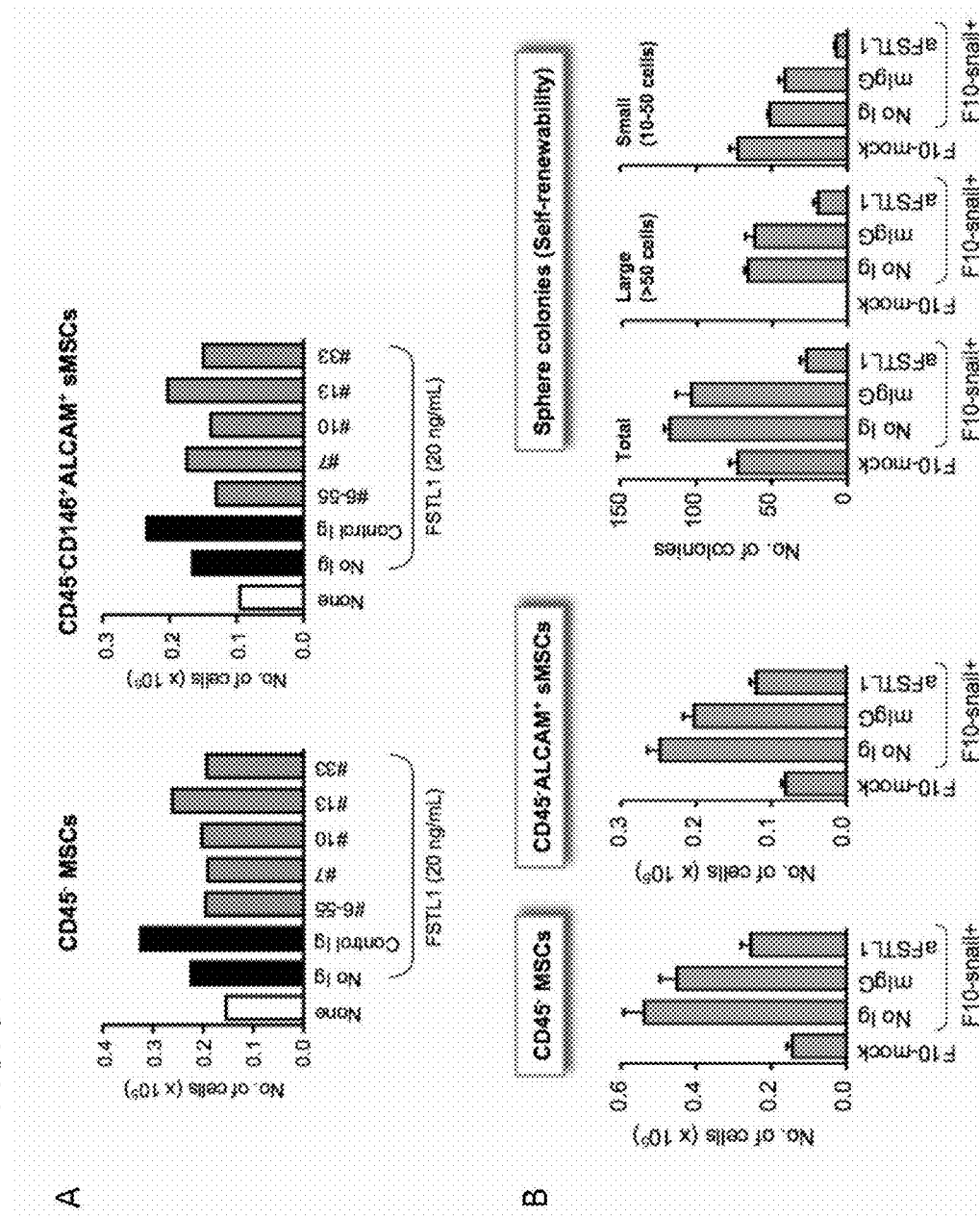
FIG. 51 shows results of a MSC induction inhibition test using mouse bone marrow cells. In panel A, the left graph depicts CD45+ MSC cells, and the right panel depicts CD45$^+$CD146$^+$ALCAM$^+$ sMSCs. The left bar depicts none, and the second bar from the left to the rightmost bar show results obtained in FSTL1 (20 ng/ml) and depict no immunoglobulin, mouse immunoglobulin, and the antibody #6-55, #7, #10, #13, and #33 of the present invention in order. Panel B depicts CD45$^-$ MSC cells, CD45$^-$ALCAM$^+$ sMSC cells, and sphere colonies (self-renewability). The leftmost bar depicts F10-mock, and the second bar from the left to the rightmost bar depict F10-snail+. Results about no immunoglobulin, mouse immunoglobulin, and the anti-FSTL1 antibody are shown in order from the second bar from the left. The results are indicated by the number of cells in the left and middle graphs. The sphere colonies represent the number of colonies. Among the 3 graphs of the sphere colonies, the left graph shows the total number, the middle graph shows large colonies (>50 cells), and the right graph shows small colonies (10 to 50 cells).

The results are shown in FIG. 51. As shown in FIG. 51A, in the MSC induction inhibition test of this Example, #7, #10, #13, and #33 exhibited a strong inhibitory effect equivalent to or higher than that of #6-55 in flow cytometry analysis. As a result, #7, #10, and #33 exhibited high MSC induction inhibitory activity equivalent to or higher than that of #6-55, and reproducibility was able to be confirmed in these 3 clones.

(Influence on MSC Expansion Induced by Tumor Cell)

In this Example, whether or not the anti-FSTL1 antibody could inhibit MSC expansion induced by a culture supernatant of Snail+ tumor cells was evaluated in a MSC induction system using bone marrow cells. C57/BL/6 mouse-derived bone marrow cells were supplemented with the culture supernatant of Snail+ tumor cells and each antibody (10 µg/mL) and cultured for 8 days under stimulation. Then, the following 2 cell groups were analyzed by flow cytometry.
1) General cell fraction "CD45(−) cells" containing MSCs at a high rate
2) "CD45(−)ALCAM(+)CD271(+) cells (=sMSCs)" increasing in number in association with cancer metastasis Formed sphere colonies were classified into large colonies each formed by 50 or more cells and small colonies each formed by 50 or less cells, and observed under a microscope on culture day 8. As a result, as shown in FIGS. 51B to 51D, the induction of MSCs and sMSCs was remarkably inhibited, and the formation of sphere colonies exhibiting the ability to self-renew, which typifies the nature of stem cells, was also strongly suppressed. This suggested the possibility that the FSTL1 antibody exerts an antitumor effect in vivo by inhibiting the induction of MSCs amplified by cancer metastasis.

Example 28: Treg Induction Inhibition Test Using Mouse Spleen Cell

In this Example, newly prepared 3 anti-FSTL1 antibodies differing in epitope were evaluated for their inhibitory activity against Treg induction in a mouse system.

(Material and Method)

In this Example, the experiment was conducted according to Example 17. Specifically, 5 µg/mL of each antibody was added to a system in which C57/BL/6 mouse-derived spleen cells ($2 \times 10^6$ cells) were stimulated with 5 ng/ml of FSTL1. After culture for 3 days, the percentage (%) of a Foxp3+ CTLA4+ cell fraction in CD4+ T cells was analyzed as Treg cells by flow cytometry. Activity was compared with #6-55 used in the preceding studies.

(Results)

Figure 52:
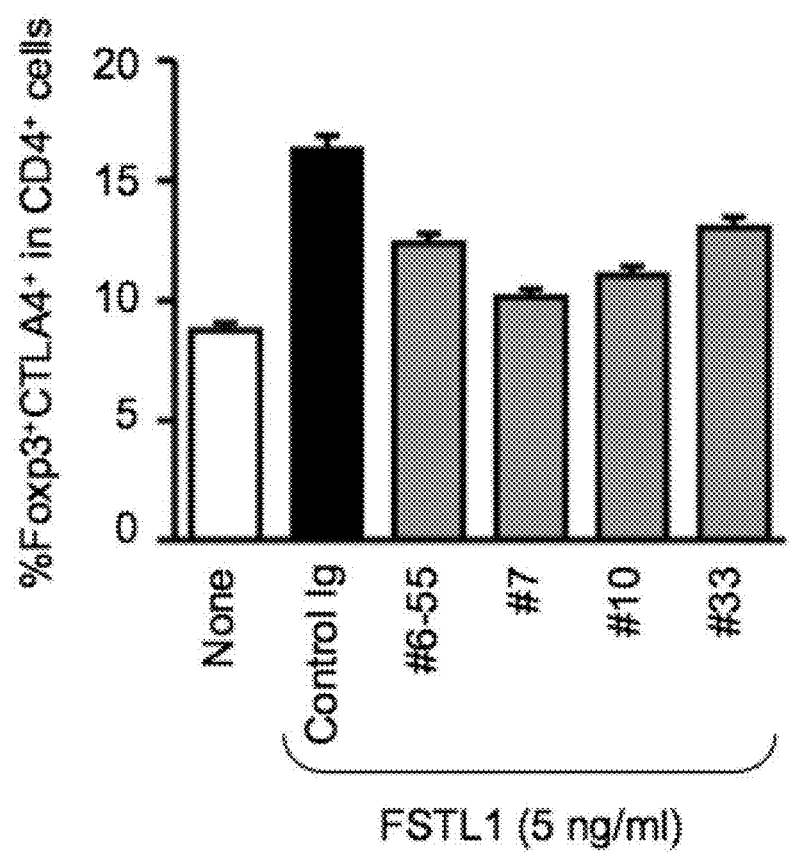
FIG. 52 shows results of a Treg induction inhibition test using mouse spleen cells. The graph shows the percentage of Foxp3$^+$CTLA4$^+$ cells in CD4$^+$ cells. The leftmost bar depicts none, and the second bar from the left to the rightmost bar show results of the experiment in the presence of FSTL (5 ng/ml). Mouse immunoglobulin, and the antibody #6-55, #7, #10, and #13 of the present invention are depicted in order from the second bar from the left.

As a result, as shown in FIG. 52, all of the new 3 clones suppressed Treg induction, as compared with the control antibody. Particularly, #7 and #10 exhibited strong suppressive activity equal to or higher than that of #6-55. The Treg induction inhibitory activity of the anti-FSTL1 antibody was also able to be properly confirmed in a human evaluation system using human peripheral blood cells in other Examples. High-impact inhibitory activity was more clearly observed in this mouse evaluation system in this Example. Both #7 and #10 are clones recognizing 205-228 a.a. of FSTL1, indicating that in addition to 148-162 a.a. recognized by #6-55, 205-228 a.a. is also a region important for the activity of FSTL1.

Example 29: Inhibitory Activity of Newly Prepared 3 Anti-FSTL1 Antibodies Differing in Epitope Against Mouse Tumor Activation In this Example, newly prepared 3 anti-FSTL1 antibodies differing in epitope were evaluated for their inhibitory activity against mouse tumor activation.

(Material and Method)

A melanoma cell line F10-snail+ forced to express mouse Snail was supplemented with 5 µg/ml of the anti-FSTL1 antibody or a control antibody (anti-DNP antibody) and cultured for 3 days, and change in the properties of tumor cells was analyzed by various assays. Cell adhesion ability was evaluated by culturing the cells for 2 hours using a fibronectin-coated plate, and then counting the number of cells that adhered to the plate. The invasive capacity of the cells was evaluated by culturing the cells for 4 hours using Matrigel-coated transwell chamber, and then counting the number of cells that permeated the membrane. As for bone metastasis-associated molecule expression, the expression of typical molecular markers CCR2 and RANKL was analyzed by flow cytometry.

(Results)

Figure 53:
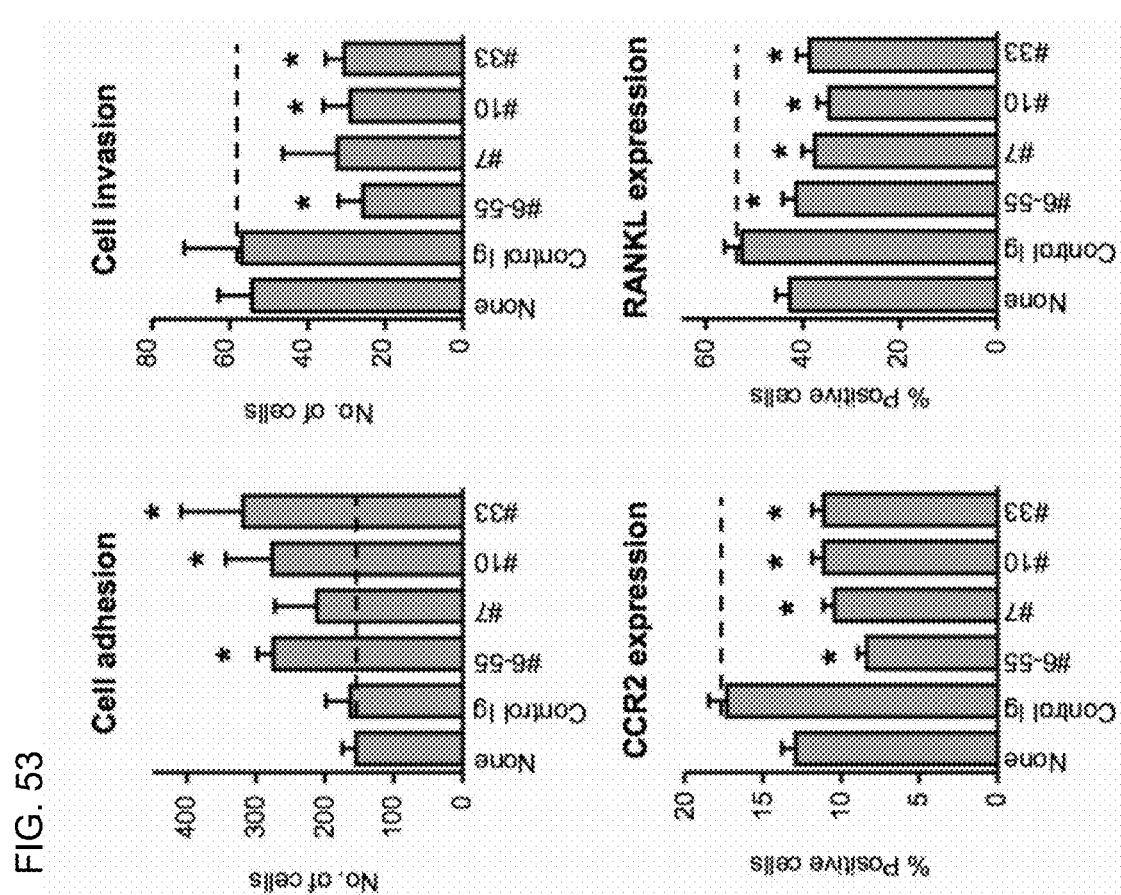
FIG. 53 shows results of evaluating newly prepared 3 anti-FSTL1 antibodies (#7, #10, and #33) differing in epitope for their inhibitory activity against mouse tumor activation. The upper left graph shows cell adhesion, the upper right graph shows cell invasion, the lower left graph shows CCR2 expression, and the lower right graph shows RANKL expression. In each graph, none, control immunoglobulin, and the antibody #6-55, #7, #10, and #33 of the present invention are depicted from the left to the right. * represents statistical significance (p<0.05).
Figure 54A:
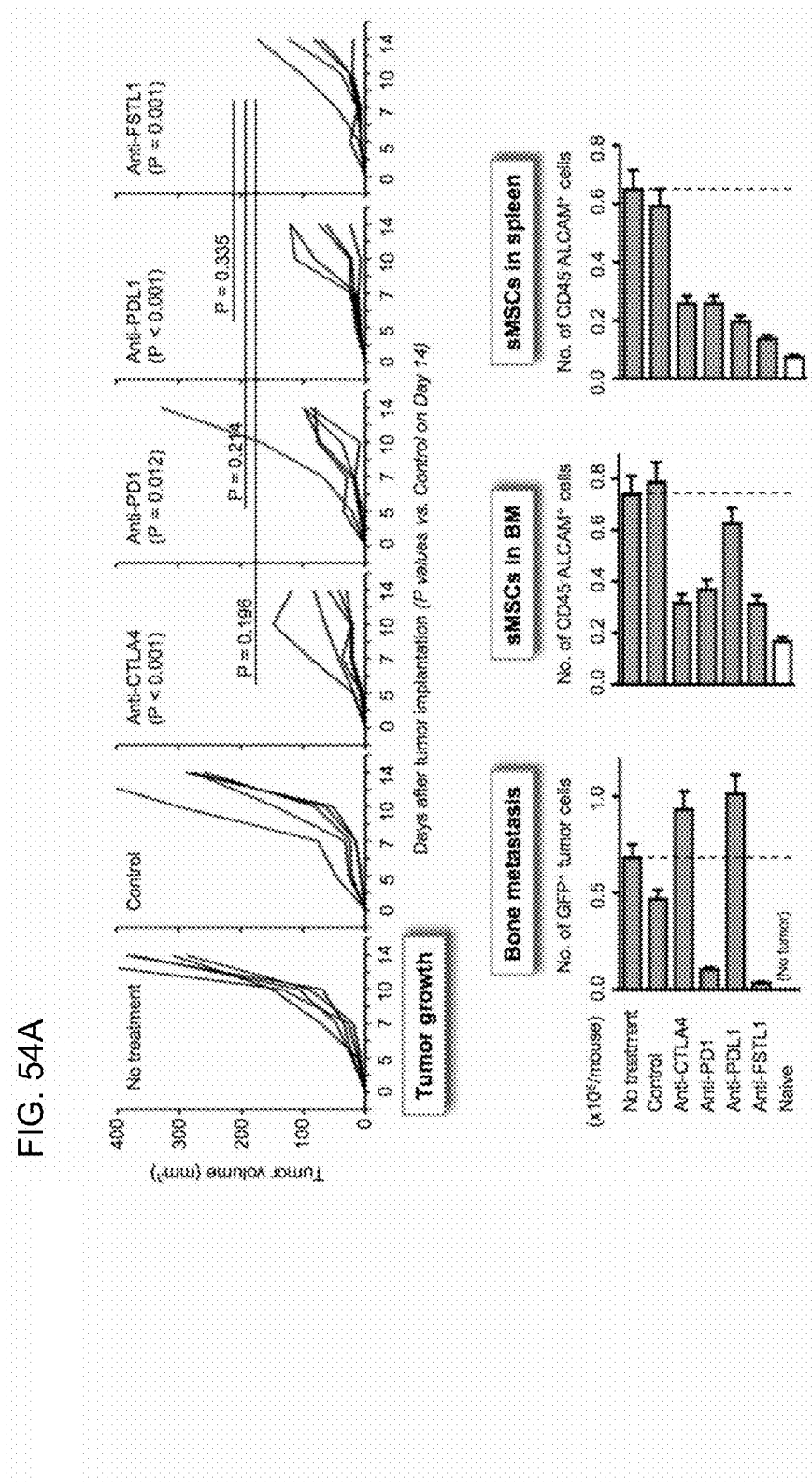
FIGS. 54A to 54D show results of comparing in vivo drug efficacy between antibody drugs for immune mitigation already used clinically and an anti-FSTL1 antibody using Snail+ tumor bone metastasis models.
Figure 54B:
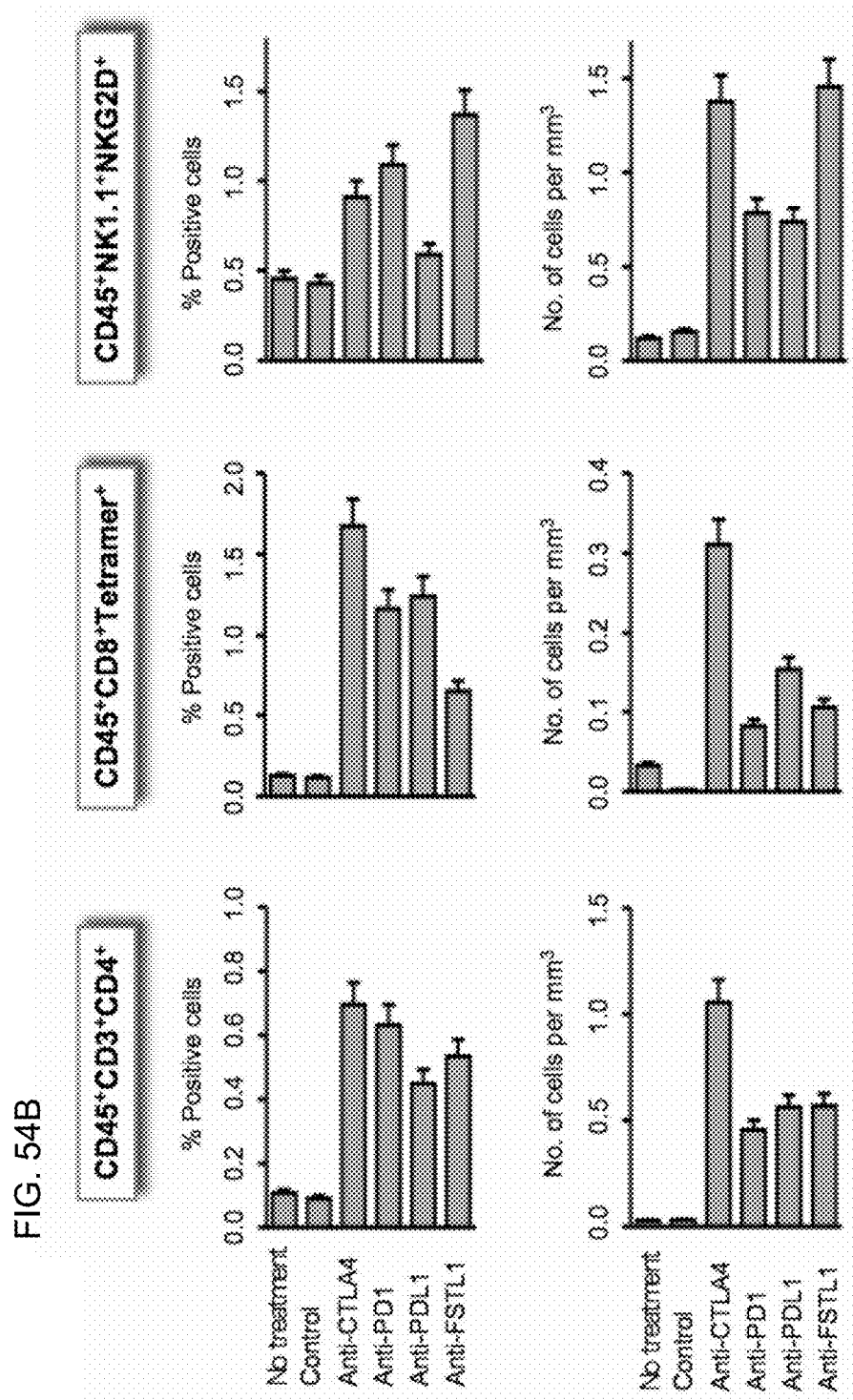
Figure 54C:
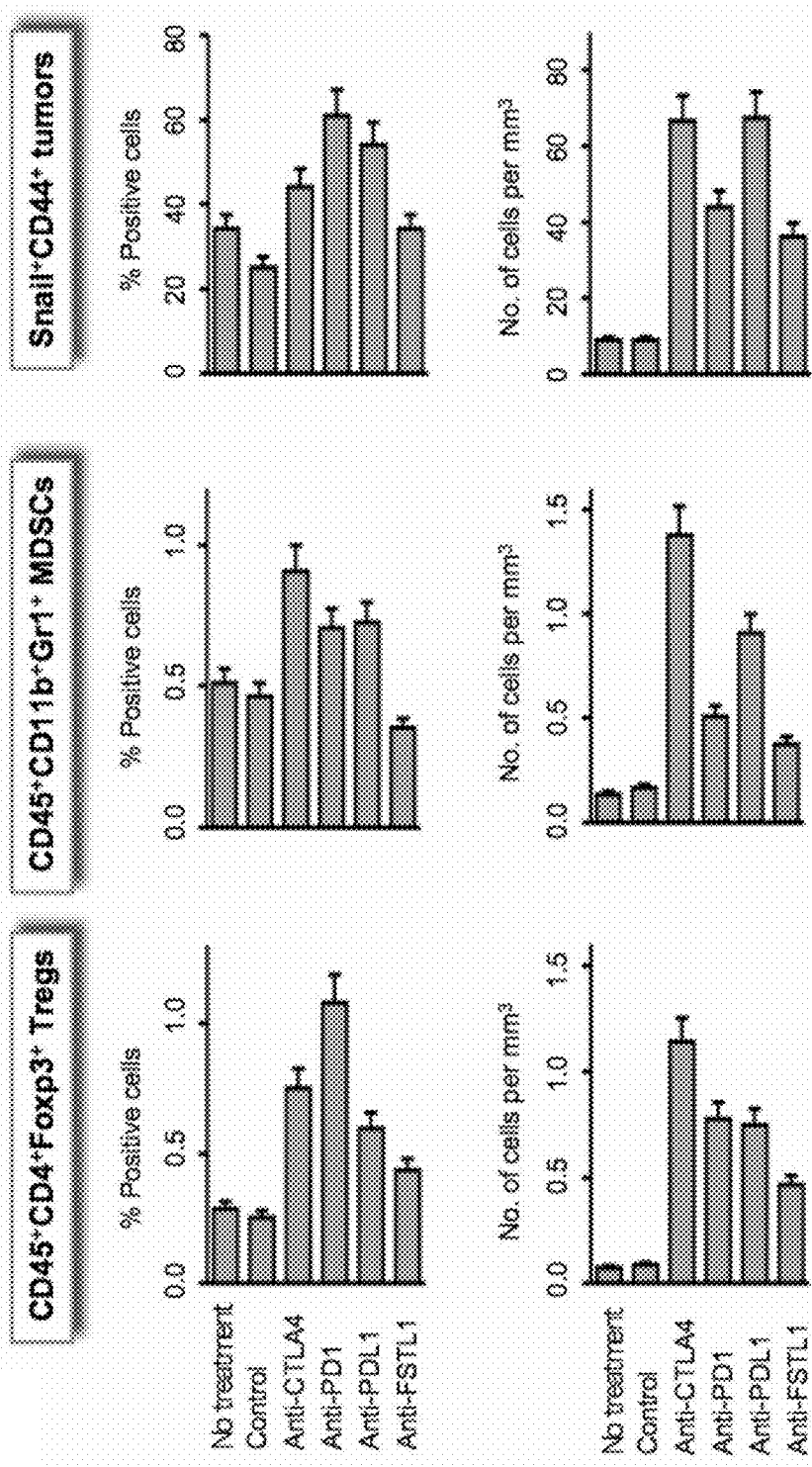
Figure 54D:
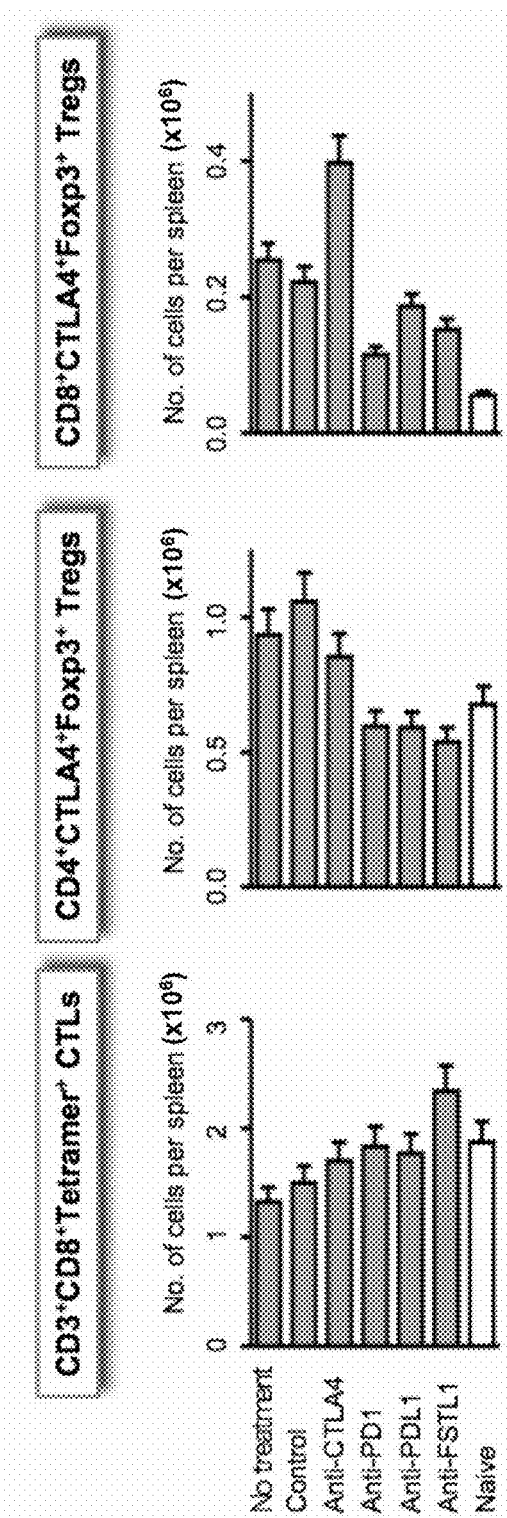

As shown in FIG. 53, all of the new clone antibodies significantly reduced the expression of CCR2 and RANKL and the invasive capacity of the cells and enhanced cell adhesion, as compared with the control antibody. This means that the cells were converted to epithelial cells. Both activities were substantially equivalent to those of #6-55, and no large difference was seen.

<Example 30: In Vivo Drug Efficacy Comparison Between Antibody Drug for Immune Mitigation Already Used Clinically and Anti-FSTL1 Antibody Using Snail+ Tumor Bone Metastasis Model>

Drugs for immune mitigation such as anti-CTLA4 antibodies have received attention because their administration into tumor can directly ameliorate an immunosuppressed environment in the tumor acting advantageously to cancer cells, and can effectively enhance antitumor immunity (Clin Cancer Res 20: 1747, 2014). Thus, in vivo drug efficacy was compared between antibody drugs for immune mitigation already used clinically and the anti-FSTL1 antibody using Snail+ tumor bone metastasis models.

(Material and Method)
1. Experimental protocol
1-1. Experiment group (n=5)
1. No treatment (0.9% NaCl as a sham)
2. Control mouse IgG (mouse chimeric anti-hemagglutinin antibody, also referred to as aHema)
3. Anti-CTLA4 mAb (Clone 9H10, BioLegend)
4. Anti-PD1 mAb (Clone 9F.1A12, BioLegend)
5. Anti-PDL1 mAb (Clone 10F.9G2, BioLegend)
6. Anti-FSTL1 mAb (#6-55)
7. Naive (no tumors, no treatment)
1-2. Experimental procedure
Day 0: transplantation of GFP+ Snail+B16-F10 tumor cells ($3 \times 10^5$ cells subcutaneously & $2 \times 10^4$ cells intravenously)
Day 5: intratumoral administration of the antibody (corresponding to 200 µg/mouse=10 mg/kg)
Day 14: various assays
1-3. Index for drug efficacy evaluation
The following was used as an index for drug efficacy evaluation.
Effects on the growth of subcutaneous tumor (calculation of tumor volume by tumor size measurement)
Effects on bone metastasis (amount of GFP+ tumor cells in bone marrow)
Effects on sMSC expansion in bone marrow or the spleen
Influence on the immune system
(Procedure)
The tumor volumes of the mice were measured 5, 7, 10, and 14 days after tumor implantation. Methods for evaluating effects on subcutaneous tumor growth, bone metastasis, and sMSC expansion in bone marrow and the spleen were performed in the same way as in Example 17. In order to evaluate influence on the immune system, the contents and numbers of CD4+ T cells (CD45+CD3+CD4+; FITC-labeled anti-CD3 antibody, PE-labeled anti-CD4 antibody, and Cy5-labeled anti-CD45 antibody, all from Becton, Dickinson and Company), tumor-specific CD8+ T cells (CD45+CD8+ tetramer+; FITC-labeled anti-CD8 antibody manufactured by Becton, Dickinson and Company, PE-labeled tetramer manufactured by Medical & Biological Laboratories Co., Ltd. (MBL), and Cy5-labeled anti-CD45 antibody), activated NK cells (CD45+NK1.1+NKG2D+; FITC-labeled anti-NK1.1 antibody, PE-labeled anti-NKG2D antibody, and Cy5-labeled anti-CD45 antibody, all from Becton, Dickinson and Company), immunosuppressive T cells (CD45+CD4+FOXP3+ Tregs; FITC-labeled anti-Foxp3 antibody manufactured by eBiosciences, PE-labeled anti-CD4 antibody, and Cy5-labeled anti-CD45 antibody), and MDSCs (CD45+CD11b+Gr1+ MDSCs; FITC-labeled anti-CD11b antibody, PE-labeled anti-Gr1 antibody, and Cy5-labeled anti-CD45 antibody, all from Becton, Dickinson and Company), which were cell groups in charge of antitumor immunity that invaded tumor, were analyzed by flow cytometry. Also, the content and number of highly metastatic tumor cells (Snail+CD44+ tumors; PE-labeled anti-Snail antibody manufactured by eBiosciences and Cy5-labeled anti-CD44 antibody manufactured by Becton, Dickinson and Company) in subcutaneous tumor was analyzed by flow cytometry.

(Results)

The growth of subcutaneous tumor was significantly suppressed in all of the treatment groups compared with the control antibody administration group, and no significant difference was confirmed among the treatment groups (FIG. 54-1). However, bone metastasis and MSC induction in bone marrow and the spleen were significantly suppressed by the FSTL1 antibody, whereas the CTLA4 antibody and the PDL1 antibody rather enhanced bone metastasis, and the PDL1 antibody did not inhibit MSC induction in bone marrow (FIG. 54-1). As a result of culturing bone marrow cells, the properties of tumor cells present therein differ between both groups. A large number of sphere colonies were formed in the CTLA4 antibody administration group, whereas strong adhesive properties were exhibited in the PDL1 antibody administration group.

On the other hand, as a result of analyzing immunocyte groups (TILs) that received the antibody and invaded subcutaneous tumor, a large number of CD4+ T cells, tumor-specific CD8+ T cells, and activated NK cells invaded tumor in all of the treatment groups (FIG. 54-2). Particularly, these antitumor effector cell groups were found to exceedingly remarkably increase in number by the intratumoral administration of the CTLA4 antibody. Interestingly, a larger number of activated NK cells, which have neither received attention nor been analyzed so far, than the number of tumor-specific CD8+ T cells invaded tumor in the FSTL1 antibody group, as with this CTLA4 antibody group (FIG. 54-2). NK cells are major effector cells of the natural immune system, as with MSC, and have also been reported as cells most susceptible to a suppressive effect by MSCs. Thus, the number or functions of NK cells were presumably improved or enhanced drastically because MSCs drastically decreased in number by the administration of the FSTL1 antibody.

As mentioned above, the antitumor effector cell groups increased in number in all of the treatment groups. Referring to the immunosuppressive cell groups, Tregs or MDSCs rather increased in number in the tumor of the existing antibody drug administration groups. Particularly, the MDSC expansion was markedly seen in the CTLA4 antibody administration group and the PDL1 antibody administration group (FIG. 54-3). Also, the CTLA4 antibody was unable to suppress Treg expansion in the spleen, and CD8+ Tregs increased in number (FIG. 54-4). This may be a rebounding effect after a lapse of days after administration, or a feedback phenomenon in which other immunosuppressive cell groups attempted to compensate for a part where CD4+ Tregs decreased in number. In an intratumoral environment, it is possible that tumor cells are stimulated by, for example, cytokines released by immunocytes that have invaded the environment, to induce EMT, etc. Therefore, change in tumor cells was also confirmed. First, the expression of main EMT marker Snail/CD44 was analyzed. As a result, the original tumor cells used in transplantation were Snail+CD44+, whereas a subpopulation fraction with the enhanced expression intensity of these markers was seen in tumor cells separated from subcutaneous tumor, demonstrating that EMT was rather promoted by treatment (FIG. 54-3). This de novo EMT was particularly markedly seen in the CTLA4 antibody administration group and the PDL1 antibody administration group in which MDSCs increased in number and bone metastasis was also aggravated. As seen from these results, the CTLA4 antibody and the PDL1 antibody were certainly able to recruit antitumor immunity-enhancing members into tumor to suppress tumor growth, but were unable to suppress the expansion of immunosuppressive cell groups, de novo EMT in tumor cells, etc. Therefore, systemic antitumor immunity was not ameliorated. As a result, presumably, bone metastasis was unable to be sufficiently inhibited. On the other hand, no major weak point was seen in data on the PD1 antibody. Particularly, the volume of bone metastasis or the amount of sMSCs is probably attributed to the very drastically decreased number of bone marrow cells. In other words, when the bone marrow cells of the PD1 antibody administration group were cultured, a large number of tumor cells formed colonies, as with the CTLA4 antibody administration group. In actuality, bone metastasis was probably rather aggravated, and tumor cells presumably accumulated in large amounts or grew excessively in a bone environment so that the growth of bone marrow cells was suppressed to drastically decrease the number of cells. The CTLA4 antibody was found to effectively recruit antitumor effector cells into tumor in this intratumoral administration compared with systemic administration. On the other hand, the FSTL1 antibody has a high effect of suppressing inferior parts, but does not have a much high effect of recruiting antitumor effector cells.

Example 31: Mouse Lung Cancer Model

In this Example, drug efficacy was evaluated using mouse lung cancer models in anticipation of the development of the anti-FSTL1 antibody as a therapeutic drug for lung cancer.

(Material and Method)
Experimental protocol
Experiment group (n=5)
1. Isotyoe mouse IgG (aHema)
2. Anti-FSTL1 mAb (#6-55)
3. Normal mice
1-2. Experimental procedure
Day 0: transplantation of mouse lung cancer 3LL cells ($1\times10^6$ cells subcutaneously & $5\times10^5$ cells intravenously)
Day 3: intraperitoneal administration of the antibody (first dose, corresponding to 200 μg/mouse=10 mg/kg)

Figure 55:
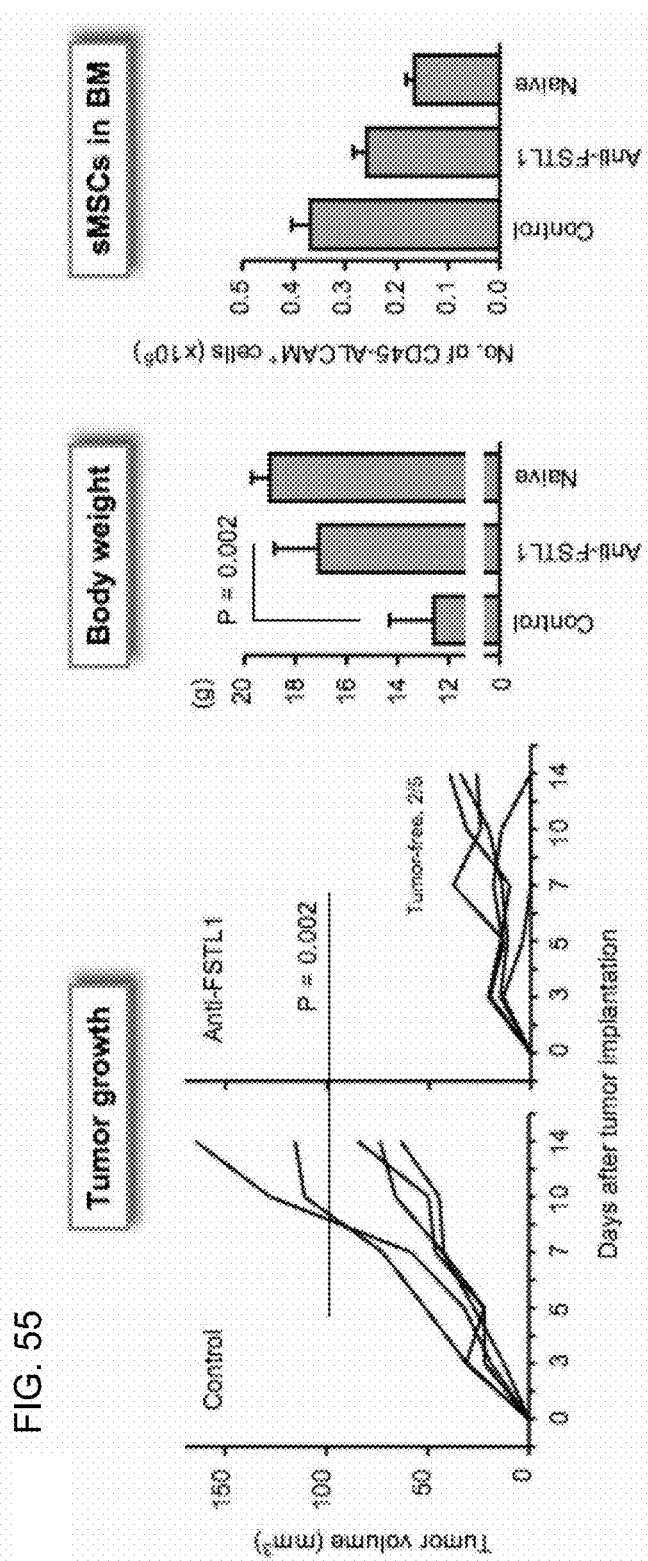
FIG. 55 shows results of evaluating drug efficacy (tumor growth, body weight, and the number of sMSCs in bone marrow) using mouse lung cancer models. For the tumor growth, statistical significance is indicated by p value. A control is depicted on the left, and an anti-FSTL1 antibody is depicted on the right. The abscissa shows the number of days after tumor implantation. The ordinate shows tumor volume (mm$^3$). The middle graph shows animal body weight. A control, an antibody FSTL1 antibody, and naive are depicted from the left to the right. The body weight is indicated by g. The right graph shows sMSCs in bone marrow. A control, an anti-FSTL1 antibody, and naive are depicted from the left to the right. The number of CD45$^-$ ALCAM$^+$ cells (×10$^6$) is shown.

Day 7: intraperitoneal administration of the antibody (second dose, corresponding to 200 µg/mouse=10 mg/kg)
Day 14: various immunological assays
1-3. Index for drug efficacy evaluation
Effects on subcutaneous tumor growth (calculation of tumor volume by tumor size measurement)
Ameliorating effect on mouse emaciation (measurement of mouse body weight)
Effects on MSC expansion (CD45− cells in bone marrow or the spleen)
Influence on immune response, etc.
(Procedure)
Subcutaneous tumor growth was measured 3, 5, 7, 10, and 14 days after implantation. Body weights, effects on MSC expansion, and influence on immune response were measured on day 14 in the same way as in Examples described above.
(Results)
As shown in FIG. 55, subcutaneous tumor growth was strongly suppressed by the administration of the anti-FSTL1 antibody, as compared with the control antibody administration group, and tumor disappeared in two out of the five mice. In this model, tumor metastasis to any organ was not macroscopically observed. 14 days after tumor implantation, the mice were too emaciated to walk, as with the bone metastasis models used in the preceding tests, even though at an early stage after tumor implantation. However, weight loss, emaciation, fluffing or the like was not observed in the anti-FSTL1 antibody administration group, and all of the mice were fine.

On the other hand, various immunocytes including MSCs, Tregs, and MDSCs were analyzed as to tumor-infiltrating cells, bone marrow cells, and spleen cells. However, large change was seen in only CD45-ALCAM+ cells which are cancer metastasis-associated sMSCs that became a focus of attention in the bone metastasis models. Although this model was confirmed to cause no bone metastasis, sMSCs increased in number only in bone marrow and decreased in number by the administration of the anti-FSTL1 antibody. 3LL cells were also found to highly express Snail, which presumably incurred sMSC expansion.

These results demonstrated again that FSTL1 inhibitory treatment is effective for cancer types, for example, 3LL cancer, having a common trait, such as "Snail" or "sMSCs". It is expected that lung cancer can also be a cancer type targeted by FSTL1 antibody administration in clinical treatment.

Figure 56:
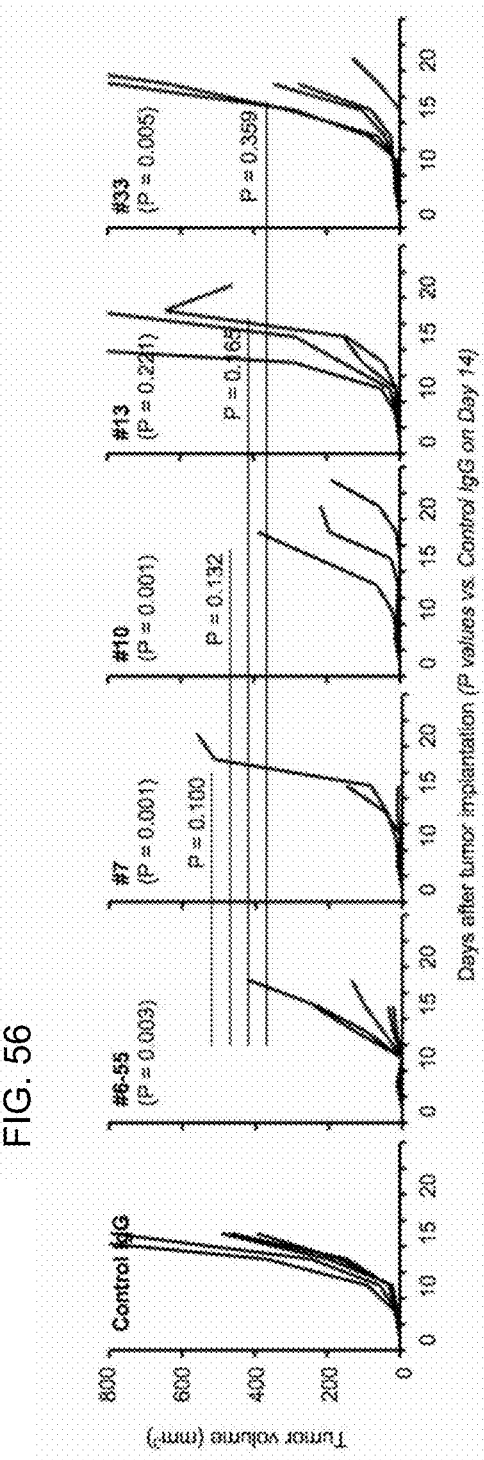
FIG. 56 FIGS. 56 and 57 show the results of evaluating the in vivo drug efficacy of each anti-FSTL1 antibody clone using Snail+ tumor bone metastasis models.
Figure 57:
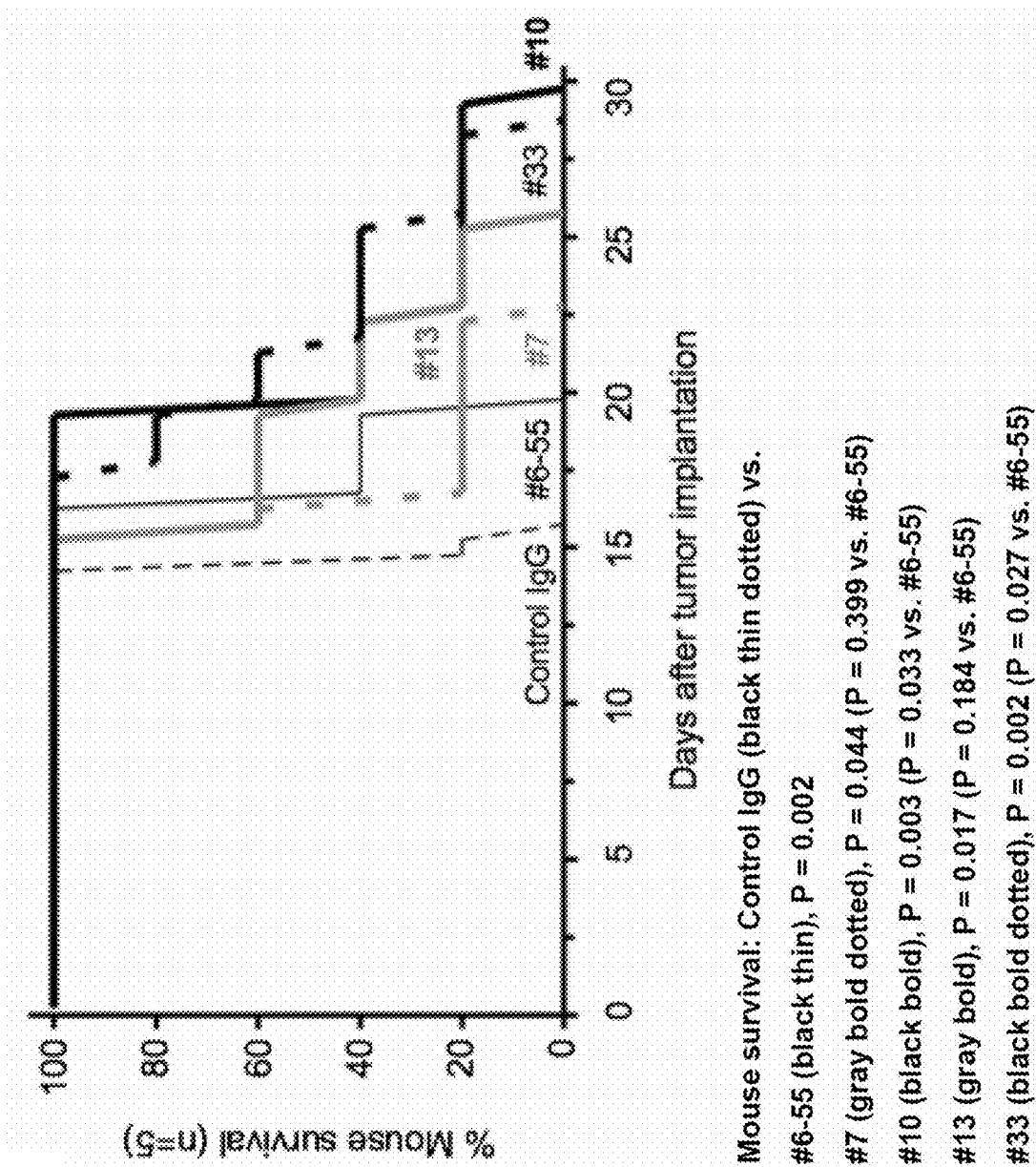

Example 32: Evaluation of In Vivo Drug Efficacy of Each Anti-FSTL1 Antibody Clone In this Example, 4 novel antibody clones confirmed to have effectiveness in the in vitro screening of drug efficacy (#7, #10, #13, and #33) were comparatively evaluated for their in vivo therapeutic effects using, as a positive control, #6-55 used in the preceding tests.
(Material and Method)
Experimental protocol
Experiment group (n=5)
Control IgG (anti-DNP mAb)
6-55
7
10
13
33
1-2. Experimental procedure
Day 0: transplantation of GFP+F10-snail+ tumor cells ($3 \times 10^5$ cells subcutaneously & $2 \times 10^4$ cells intravenously)
Day 4: intraperitoneal administration of the antibody (first dose, 10 mg/kg)
Day 7: intraperitoneal administration of the antibody (second dose, 10 mg/kg)
1-3. Index for drug efficacy evaluation
Suppression of subcutaneous tumor growth
Extension of mouse survival period
(Procedure)
Subcutaneous tumor was measured 4, 7, 10, 14, 17, 20, and 23 days after tumor cell transplantation.
(Results)
As shown in FIG. 56, all of the clones except for #13 exhibited statistically significant suppressive activity, as with #6-55, against subcutaneous tumor growth, as compared with the control antibody administration group, and no significant difference from #6-55 was seen. On the other hand, as shown in FIG. 57 as to the mouse survival period, all of the clones exhibited a statistically significant life-prolonging effect, as with #6-55, as compared with the control antibody administration group. Particularly, #10 and #33 exhibited therapeutic effects equal to or higher than those of #6-55. For #6-55, statistical significance is indicated at the level of $p<0.001$ of day 12 even in a test conducted at n=10. Hereinafter, the activity rank of each clone summarized on the basis of P values is shown.
Subcutaneous tumor growth suppressive effect:
7=#10>#6-55>#33>>#13
Mouse life-prolonging effect:
33=#10>#6-55>#13>#7

The comprehensive evaluation of these results indicated the possibility that "#10" has high antitumor activity exceeding that of #6-55.

While a wide range of immunocytes, i.e., CD4+ cells, CD8+ cells, and NK cells, participate in antitumor immune response caused by the inhibition of FSTL1, particularly, the CD8+ cells and the NK cells, which exhibit cytotoxic activity, were also confirmed to play an essential role therein (data not shown). In general immunotherapy, antitumor effector cells are typically CD8+ T cells. NK is often regarded as a cell group of low importance that is involved in only the early stage of carcinogenesis. Rather, it has been shown that, for example, therapeutic effects are further enhanced by the removal of CD4+ T cells including Tregs or the like. On the other hand, in the FSTL1 inhibitory treatment of the present invention, various immunocytes including CD8+ cells are recruited to exert an antitumor effect. This is probably because FSTL1 and MSCs amplified by the action of FSTL1 are most upstream key factors in a cancer-associated abnormal immune mechanism, and the inhibition of FSTL1 converted MSCs as well as their various negatively controlled downstream immune responses toward antitumor ones. In other words, the original concept for development was able to be reconfirmed, and the anti-FSTL1 antibody of the present invention differs largely in the mechanism of action from conventional immunomodifying drugs and is expected to be able to serve as a novel therapeutic drug for cancer that can thoroughly improve and appropriately activate the whole host immunity.

Specifically, the inhibition of FSTL1 is presumed to inhibit the differentiation induction of MSCs and inhibit immunosuppressive cell groups (MDSCs and Tregs), thereby activating antitumor immunocyte groups. In this Example, feasibility up to the final stage was confirmed, and it is expected that a suppressor attains effects similar to those generally exhibited by an antibody, by suppressing FSTL1.

Example 33: Characterization of Mouse Chimera

In this Example, the affinity of the produced mouse chimeric antibodies for a human FSTL1 antigen was measured.

(Material and Method)

The mouse chimeric antibodies were immobilized onto Sensor Chip CM5 (GE Healthcare Japan Corp., BR-1005-30) using Mouse Antibody Capture Kit (GE Healthcare Japan Corp., BR-1008-38), and their affinity for human FSTL1 was calculated using Biacore T-200 (GE Healthcare Japan Corp.).

(Results)

Figure 58:
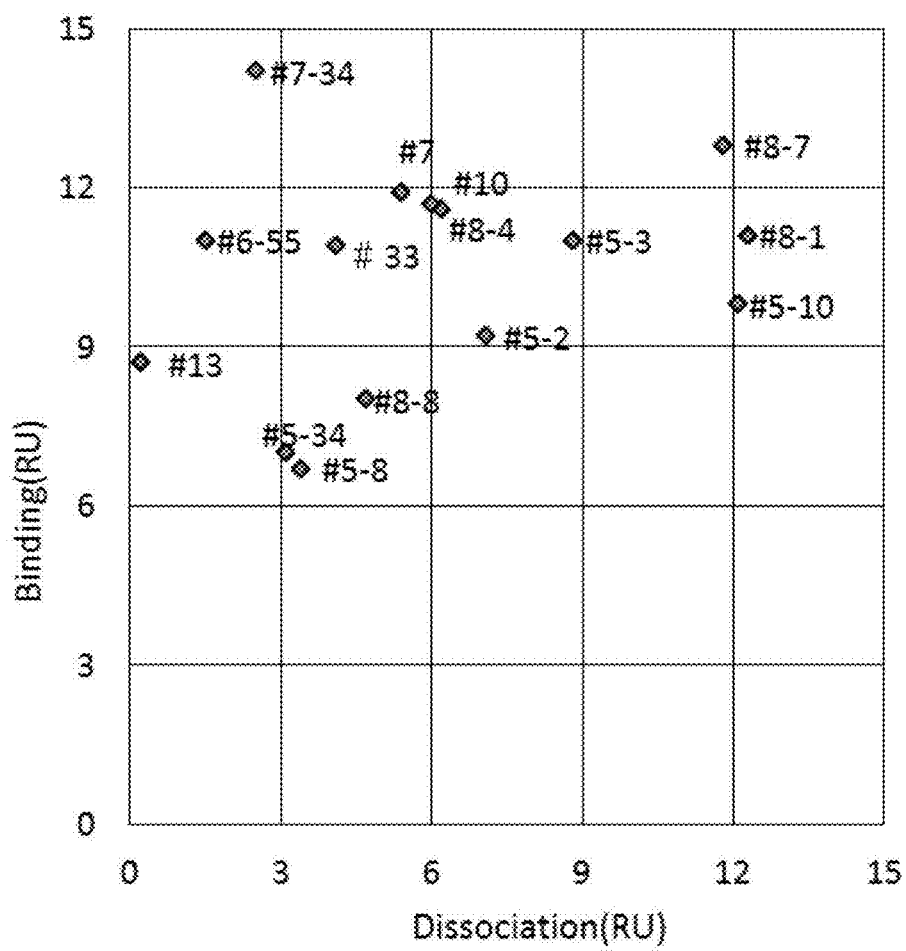
FIG. 58 shows affinity data (determined by BIACORE) on mouse chimeric antibodies. The figure is a plot of the antigen binding amounts and dissociation amounts of the mouse chimeric antibodies.

First, the exhaustive activity comparison of the obtained antibodies was conducted with the human FSTL1 concentration fixed to 10 μg/ml (Table 33-1, FIG. 58).

The ordinate of FIG. 58 shows the antigen binding amounts of the antibodies. The abscissa shows the antigen dissociation amounts of the antibodies. A higher antigen binding amount and a lower dissociation amount suggest affinity (position closer to the upper left of the figure means higher affinity). Next, the KD values of clone #6-55, #7-34, and #13 presumed to have high affinity in FIG. 58 were calculated with the antigen concentration adjusted to 0 to 20 μg/ml (Table 35-2). As a result, clone #6-55, #7-34, and #13 as well as #7, #10, #33, and the like were also found to have strong affinity in an assay system using surface plasmon resonance.

(Table 33-1) Antigen binding amount and dissociation amount of mouse chimeric antibody

TABLE 2-33-1

| Clone No. | Binding amount (RU) | Dissociation amount (RU) |
|---|---|---|
| #5-2 | 9.2 | 7.1 |
| #5-3 | 11 | 8.8 |
| #5-8 | 6.7 | 3.4 |
| #5-10 | 9.8 | 12.1 |
| #5-43 | 7 | 3.1 |
| #6-55 | 11 | 1.5 |
| #7-34 | 14.2 | 2.5 |
| #8-1 | 11.1 | 12.3 |
| #8-4 | 11.6 | 6.2 |
| #8-7 | 12.8 | 11.8 |
| #8-8 | 8 | 4.7 |
| #7 | 11.9 | 5.4 |
| #10 | 11.7 | 6 |
| #13 | 8.7 | 0.2 |
| #33 | 10.9 | 4.1 |

(Table 33-2) KD value of mouse chimeric antibody

TABLE 2-33-2

| Clone No. | $K_D$ (M) |
|---|---|
| #6-55 | $2.43 \times 10^*$ |
| #7-34 | $1.22 \times 10^*$ |
| #13 | $1.12 \times 10^*$ |

Example 34: Development and Affinity Measurement of Humanized Antibody

<Affinity of Humanized Antibody: Measurement Using Biacore T-200>

In this Example, humanized antibodies were developed, and the affinity of the developed antibodies for human FSTL1 was measured.

(Material and Method)

Nine IgG1-type humanized antibodies of #6-55 were immobilized onto Sensor Chip CM5 (GE Healthcare Japan Corp., BR-1005-30) using Human Antibody Capture Kit (GE Healthcare Japan Corp., BR-1008-38), and their affinity for human FSTL1 was calculated using Biacore T-200 (GE Healthcare Japan Corp.). The KD values were calculated with the antigen concentration adjusted to 0 to 20 μg/ml (Table 34-1). Among the 9 IgG1-type humanized antibodies of #6-55, a clone composed of a combination "H(2)-L(1)" having a high KD value was selected as a lead antibody.

(Table 34-1) Table. Affinity (KD value) comparison based on combination of H chain and L chain of humanized 6-55 antibody (IgG1 type)

TABLE 2-34-1

| | h #6-55 | | | | | | | | |
|---|---|---|---|---|---|---|---|---|---|
| | H(1)-L(1) | H(1)-L(2) | H(3)-L(1) | H(3)-L(1) | H(2)-L(1) | H(2)-L(2) | H(1)-L(3) | H(2)-L(3) | H(3)-L(3) |
| KD value (M) | $3.52 \times 10^{-8}$ | $2.50 \times 10^{-8}$ | $2.67 \times 10^{-8}$ | $3.35 \times 10^{-8}$ | $6.05 \times 10^{-8}$ | $1.13 \times 10^{-8}$ | $2.68 \times 10^{-8}$ | $4.50 \times 10^{-8}$ | $2.49 \times 10^{-8}$ |

<Preparation of Humanized Antibody>

Figure 59:
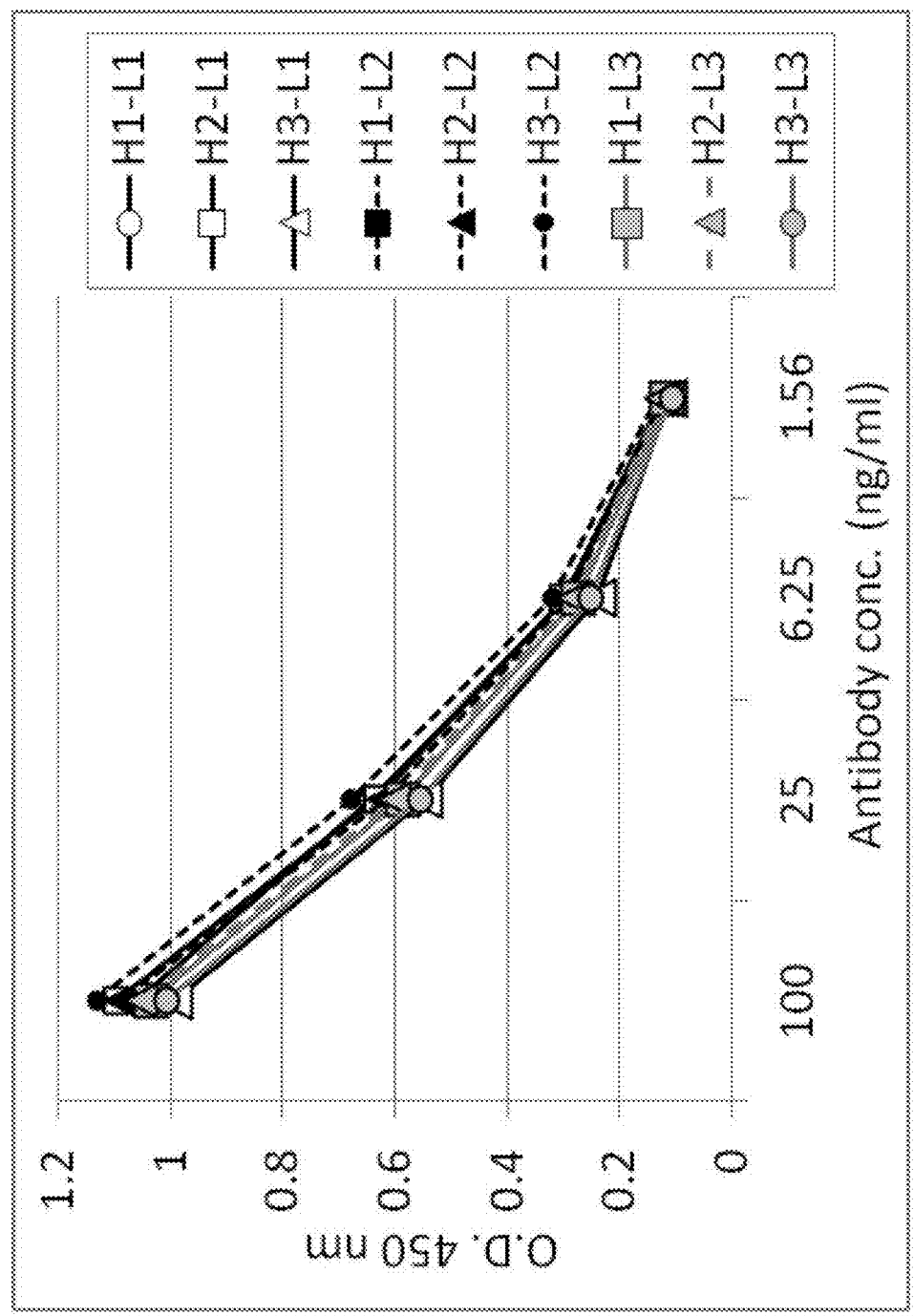
FIG. 59 FIGS. 59 and 60 show ELISA results of humanized antibodies.

On the basis of the report of Matsuda et al., Molecular Immunology 43 (2006) 634-642, a gene was designed such that frame regions present in the H chain and L chain variable regions of clone #6-55 were substituted by human sequences from the chicken sequences. The gene was synthesized. 3 types each of H chains and L chains per clone were designed and synthesized (humanized H chains (1), (2), and (3), and humanized L chains (1), (2), and (3); H chain (1) is also referred to as H(1), H1, etc., and it is understood that all of these terms refer to the same clone; the same holds true for H chain (2), H chain (3), and L chains (1), (2), and (3)). The full-length sequence of the H(1) heavy chain is represented by SEQ ID NOs: 441 and 442 (which represent nucleic acid and amino acid sequences, respectively) for IgG1 type and represented by SEQ ID NOs: 447 and 448 (which represent nucleic acid and amino acid sequences, respectively) for IgG4 type. The full-length sequence of the H(2) heavy chain is represented by SEQ ID NOs: 443 and 444 (which represent nucleic acid and amino acid sequences, respectively) for IgG1 type and represented by SEQ ID NOs: 449 and 450 (which represent nucleic acid and amino acid sequences, respectively) for IgG4 type. The full-length sequence of the H(3) heavy chain is represented by SEQ ID NOs: 445 and 446 (which represent nucleic acid and amino acid sequences, respectively) for IgG1 type and represented by SEQ ID NOs: 451 and 452 (which represent nucleic acid and amino acid sequences, respectively) for IgG4 type. The full-length sequence of the L(1) light chain is represented by SEQ ID NOs: 453 and 454 (which represent nucleic acid and amino acid sequences, respectively). The full-length sequence of the L(2) light chain is represented by SEQ ID NOs: 495 and 496 (which represent nucleic acid and amino acid sequences, respectively). The full-length sequence of the L(3) light chain is represented by SEQ ID NOs: 497 and 498 (which represent nucleic acid and amino acid sequences, respectively). The synthesized variable region genes were amplified by PCR, then treated with restriction enzymes, and transferred to L chain or H chain expression cassette vectors (restriction enzyme-treated vectors) having gene inserts of a chicken antibody leader sequence and a human IgG1 constant region. HEK293 cells were transfected with 9 types in total of combinations of the constructed H chain (1) to (3) and L chain (1) to (3) expression vectors for the clones, and humanized antibodies were purified from culture supernatants using Protein A Sepharose. As a result of conducting ELISA in order to confirm the binding activity of the purified IgG1-type humanized antibodies against human FSTL1, all of the clones were able to be confirmed to have binding activity to a given extent (FIG. 59). Among them, the humanized clone of H(2)-L(1) exhibited a numerical value higher by an order of magnitude as compared with other clones (see Table 34-1). Therefore, this clone was used in the next experiment.

<Binding Activity of Humanized Antibody: ELISA>

Figure 60:
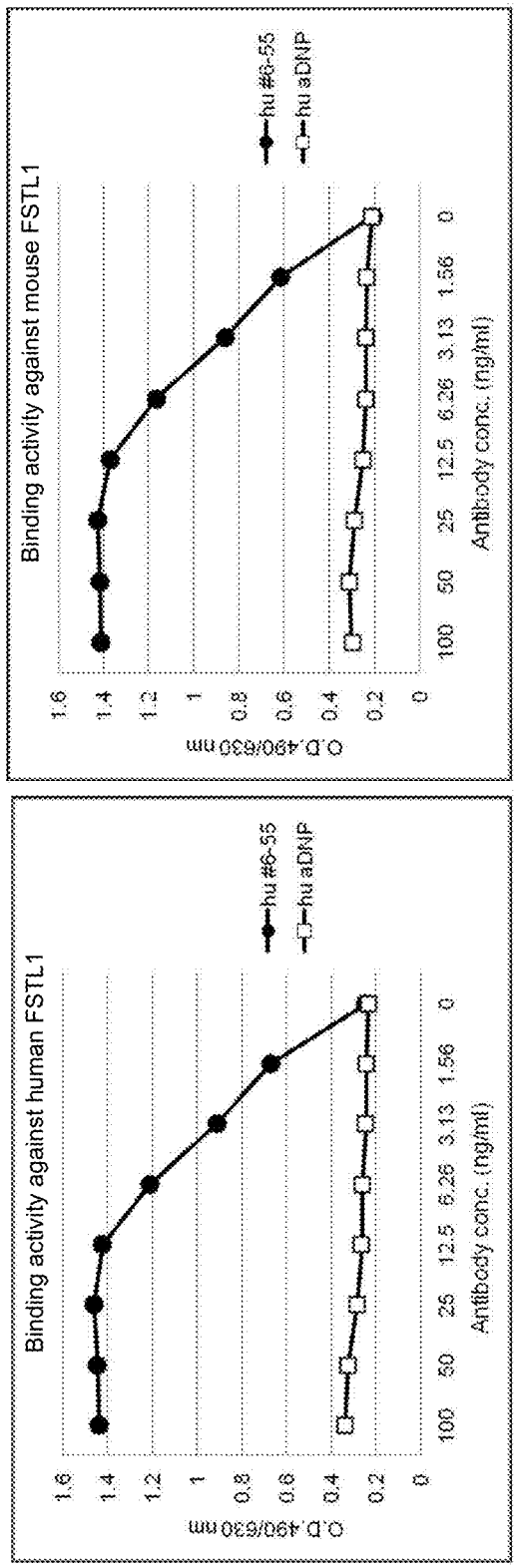
Figure 61:
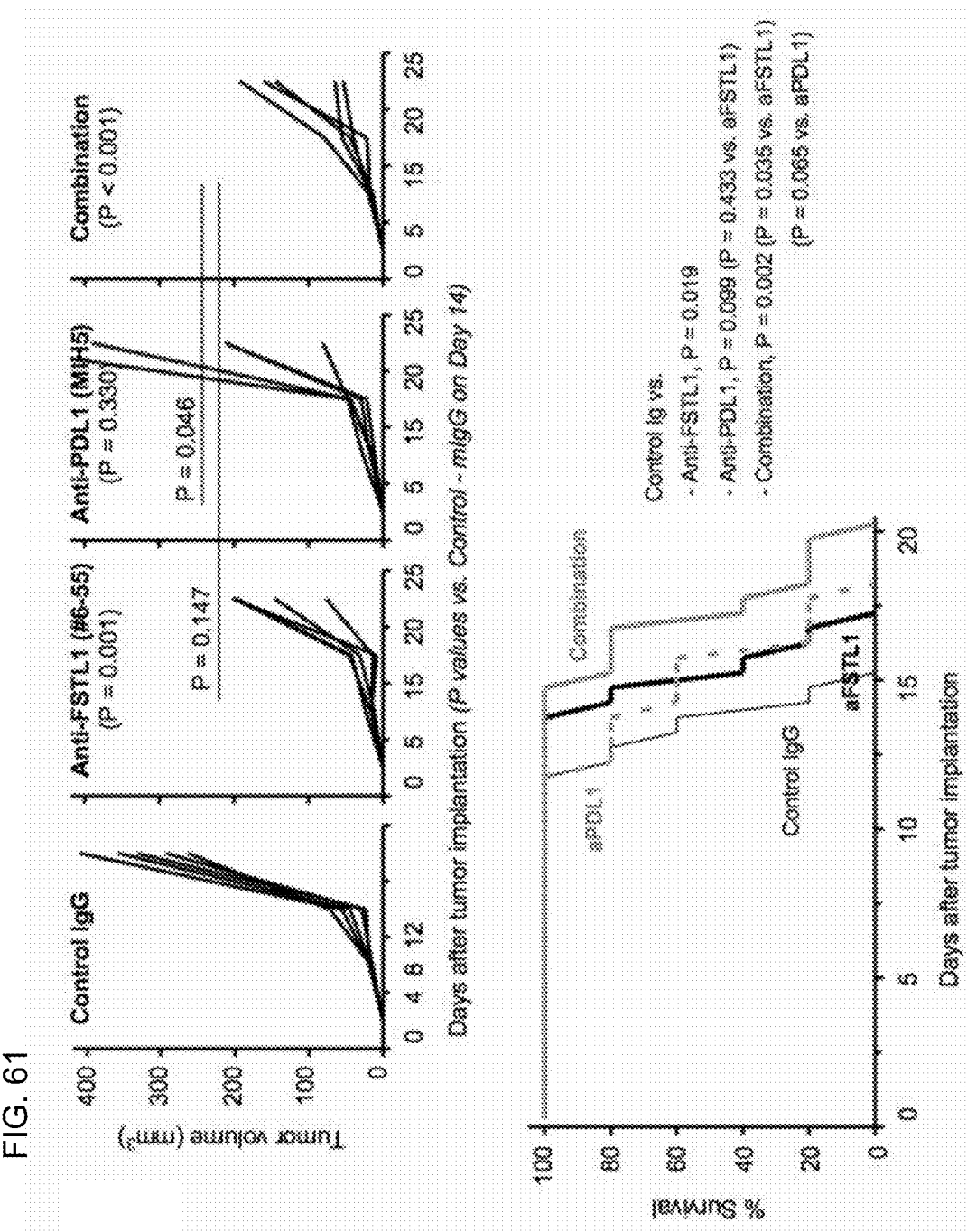
FIG. 61 shows results of confirming the reproducibility of effects brought about by combined use of an anti-FSTL1 antibody using an anti-PD-L1 antibody of another clone (clone MIH5, manufactured by Becton, Dickinson and Company). This figure shows results of evaluating drug efficacy in the combination therapy of the anti-FSTL1 antibody and the anti-PD-L1 antibody (Example 37). The 4 graphs of the upper panel show the effects of various antibodies on tumor volume over time. A control, the anti-FSTL1 antibody (5 mg/kg), the anti-PD-L1 antibody (5 mg/kg), and a combination of the anti-FSTL1 antibody (5 mg/kg) and the anti-PD-L1 antibody (5 mg/kg) are depicted from the left to the right. The numerical values within the parentheses and the numerical values on the lines (indicated by P) represent p values regarding statistical significance (day 14). The lower panel shows survival rate. The abscissa shows the number of days after tumor implantation. The ordinate shows mouse survival rate (n=5). The results about control immunoglobulin, the antibody #6-55 of the present invention (antibody FSTL1 antibody), the antibody PD-L1 antibody, and a combination of the anti-FSTL1 antibody and the anti-PD-L1 antibody are shown. Statistical significance values (p value) vs. the control immunoglobulin are indicated within parentheses, and statistical significance (p value) vs. the antibody FSTL1 antibody is indicated on the line. The control IgG was indicated by black thin line, and the anti-FSTL1 antibody is indicated by the black bold line. The anti-PD-L1 antibody is indicated by gray dotted line. The combination is indicated by gray bold line as shown in the rightmost line.

The binding activity of the purified antibody of IgG1-type humanized #6-55 H chain (2)+L chain (1) against human FSTL1 and mouse FSTL1 was confirmed by ELISA (FIG. 60). From the results of FIG. 60, it was able to be confirmed that the antibody of the present invention has similar binding activity against human FSTL1 and mouse FSTL1 and retains activity against human FSTL1.

Example 35: Combination Treatment Using Anti-PD-L1 Antibody of Different Clone

In Example 25, it was reported that when the anti-FSTL1 antibody is used in combination with various immune checkpoint inhibitory antibody drugs using F10-snail+ tumor-implanted acute bone metastasis models, only the anti-PD-L1 antibody (clone 10F.9G2, manufactured by BioLegend, Inc.) exhibits excellent synergistic effects. In this Example, an anti-PD-L1 antibody of different clone (clone MIH5, manufactured by Becton, Dickinson and Company) was used to confirm the reproducibility of effects brought about by combined use with the anti-FSTL1 antibody.

(Material and Method)
1. Experiment group (n=5)
G1. Mouse IgG control antibody
G2. Anti-FSTL1 antibody
G3. Anti-PD-L1 antibody
G4. Combination
2. Experiment schedule
Day 0: transplantation of GFP+F10-snail+ tumor cells ($3 \times 10^5$ cells/ml subcutaneously & $2 \times 10^4$ cells/ml intravenously)
Days 4 & 7: intraperitoneal administration of the antibody×2
  Mouse IgG control antibody (anti-DNP antibody): 10 mg/kg×2
  Anti-FSTL1 antibody (clone 6-55): 5 mg/kg×2
  Anti-PD-L1 antibody (clone MIH5, Becton, Dickinson and Company): 5 mg/kg×2
  Criteria for determining antitumor effects: subcutaneous tumor growth suppressive effect and extension of mouse survival period (Results & Discussion)

Unlike the results of Example 25 using clone 10F.9G2, the administration of clone MIH5 exhibited no statistically significant antitumor effect, as compared with the control antibody administration group, as to both the suppression of subcutaneous tumor growth and the number of mouse survival days. This result may reflect difference in Kd value. On the other hand, the combined use of the anti-FSTL1 antibody with MIH5 induced a significantly higher antitumor effect than that of treatment with either alone. However, such strong synergistic effects that subcutaneous tumor disappeared were not seen in the combined use with MIH5, as compared with the effects brought about by combined use with 10F.9G2 used in Example 25. Effects brought about by this combined use were very small. However, at least in this bone metastasis model, the simultaneous inhibition of PD-L1 and FSTL1 had very good compatibility, and the combined use of the 2 antibodies were found to be useful in cancer treatment.

Example 36: Study on Effect Using Mouse Colorectal Cancer Colon26 Lung Metastasis Model In the preceding tests, in vivo drug efficacy was compared between antibody drugs for immune mitigation already used clinically and the FSTL1 antibody using Snail+ tumor bone metastasis models. Here, effects brought about by combined use of the FSTL1 antibody with the PD-L1 antibody was evaluated.

(Experiment Schedule)
Day 0: transplantation of Colon26 tumor cells ($5 \times 10^5$ cells/ml subcutaneously & $5 \times 10^5$ cells/ml intravenously)
Day 5: intraperitoneal administration of the antibody (first dose, corresponding to 200 µg/mouse=10 mg/kg)
Day 8: intraperitoneal administration of the antibody (second dose, corresponding to 200 µg/mouse=10 mg/kg)

(Experiment. Effect brought about by combined use of FSTL1 antibody with PD-L1 antibody)
2-1. Experiment group (n=5)
1. Control mouse IgG (aDNP)
2. Control rat IgG (R&D)
3. Anti-FSTL1 mAb (#6-55)
4. Anti-PD-L1 mAb (Clone 10F.9G2, BioLegend)
5. Anti-FSTL1 mAb+Anti-PD-L1 mAb (Results & Discussion)

Figure 62:
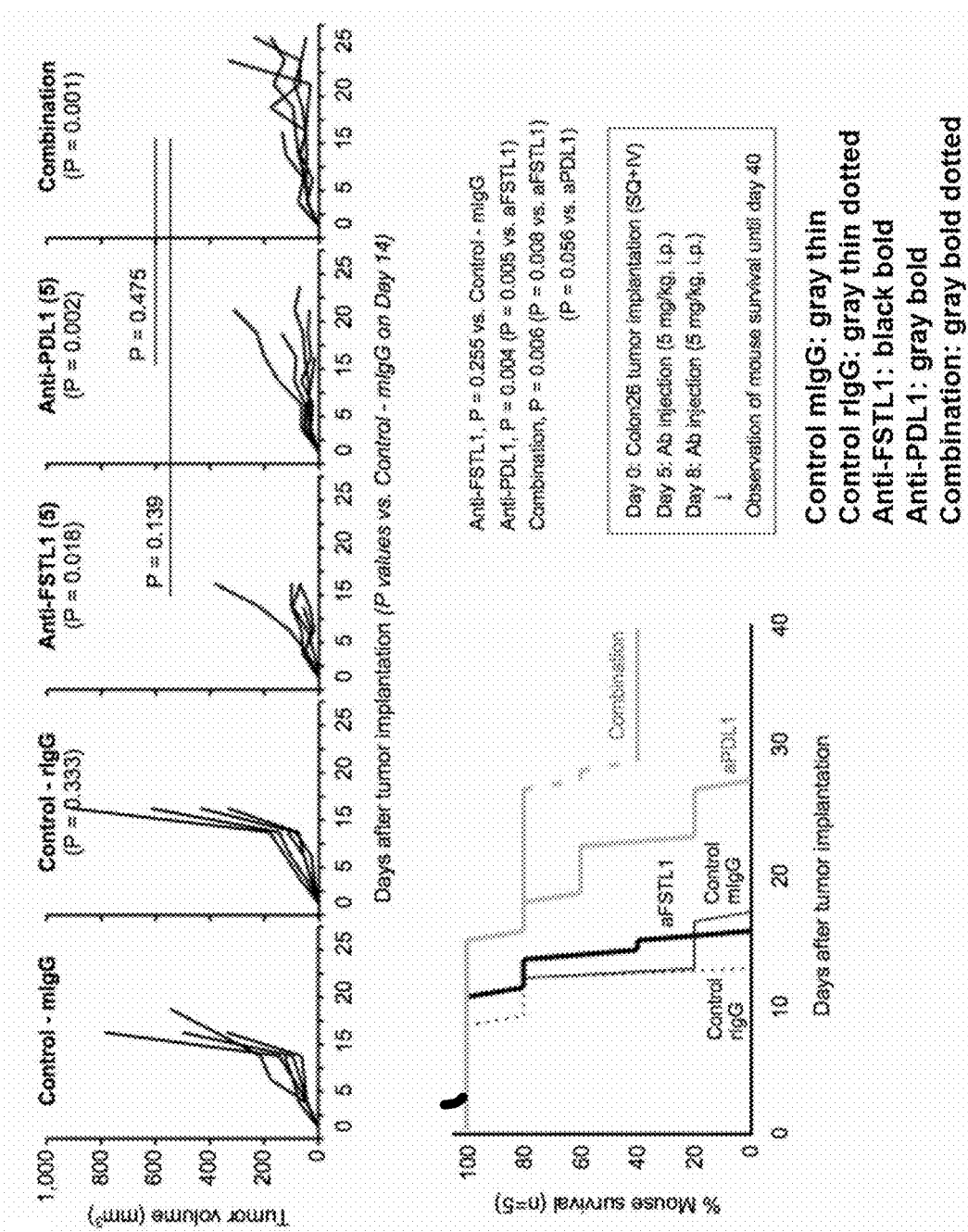
FIG. 62 shows effects brought about by combined use of a FSTL1 antibody and a PD-L1 antibody in Colon26 lung metastasis models. The left graphs of the upper panel show results of evaluating the drug efficacy of mouse immunoglobulin (control), rat immunoglobulin (control), the anti-FSTL1 antibody, and the anti-PD-L1 antibody as single agents, and the rightmost graph shows results of evaluating the drug efficacy of a combination drug of the anti-FSTL1 antibody and the anti-PD-L1 antibody (Example 37, experiment 2). The ordinate shows tumor volume. The abscissa shows the number of days after tumor implantation. The numerical values within the parentheses and the numerical values on the lines (indicated by P) represent p values regarding statistical significance (day 14). The lower panel shows survival rate. The ordinate shows survival rate. The abscissa shows the number of days after tumor implantation. The control rat IgG is indicated by gray dotted line, the control mouse IgG is indicated by black thin line, and the anti-FSTL1 antibody is indicated by the black bold line. The anti-PD-L1 antibody is indicated by gray bold line. The combination is indicated by gray dotted bold line as shown in the rightmost line.

In order to confirm the versatility of effects brought about by combined use of the FSTL1 antibody with the PD-L1 antibody, which were found in bone metastasis models, a similar experiment was conducted. Both of the antibodies significantly suppressed subcutaneous tumor growth. However, the FSTL1 antibody did not extend the survival periods of the mice, probably due to ½ (5 mg/kg) of the usual dose, whereas the PD-L1 antibody exhibited a significant extending effect (FIG. 62). This effect of the PD-L1 antibody was significantly enhanced by the combined use with the FSTL1 antibody. Thus, the good compatibility between these antibodies was able to be reconfirmed.

The present invention is illustrated above by using the preferred embodiments of the present invention. However, it is understood that the scope of the present invention should be interpreted only by claims. It is understood that the contents of patents, patent applications, and literatures cited herein are incorporated herein by reference similarly to the specific description of the contents themselves in the present specification.

INDUSTRIAL APPLICABILITY

The present invention provides prophylactic and therapeutic agent for cancer and techniques of suppressing metastasis, particularly, bone metastasis, by the mitigation of immune defect such as immunosuppression. Particularly, the present invention provides techniques available in industry (reagents, pharmaceutical industry, etc.) involved in techniques related to cancer treatment and prevention, by means of effects brought about by combined use which exerts unexpectedly remarkable effects.

[Free Text of Sequence Listing]
SEQ ID NO: 250: Nucleic acid sequence of human FSTL1
SEQ ID NO: 251: Amino acid sequence of human FSTL1
SEQ ID NO: 252: Nucleic acid sequence of mouse FSTL1
SEQ ID NO: 253: Amino acid sequence of mouse FSTL1

SEQ ID NO: 254: Nucleic acid sequence of the light chain variable region of antibody clone #5-2
SEQ ID NO: 255: Amino acid sequence of the light chain variable region of antibody clone #5-2
SEQ ID NO: 256: Nucleic acid sequence of the heavy chain variable region of antibody clone #5-2
SEQ ID NO: 257: Amino acid sequence of the heavy chain variable region of antibody clone #5-2
SEQ ID NO: 258: Nucleic acid sequence of the light chain variable region of antibody clone #5-3
SEQ ID NO: 259: Amino acid sequence of the light chain variable region of antibody clone #5-3
SEQ ID NO: 260: Nucleic acid sequence of the heavy chain variable region of antibody clone #5-3
SEQ ID NO: 261: Amino acid sequence of the heavy chain variable region of antibody clone #5-3
SEQ ID NO: 262: Nucleic acid sequence of the light chain variable region of antibody clone #5-8
SEQ ID NO: 263: Amino acid sequence of the light chain variable region of antibody clone #5-8
SEQ ID NO: 264: Nucleic acid sequence of the heavy chain variable region of antibody clone #5-8
SEQ ID NO: 265: Amino acid sequence of the heavy chain variable region of antibody clone #5-8
SEQ ID NO: 266: Nucleic acid sequence of the light chain variable region of antibody clone #5-10
SEQ ID NO: 267: Amino acid sequence of the light chain variable region of antibody clone #5-10
SEQ ID NO: 268: Nucleic acid sequence of the heavy chain variable region of antibody clone #5-10
SEQ ID NO: 269: Amino acid sequence of the heavy chain variable region of antibody clone #5-10
SEQ ID NO: 270: Nucleic acid sequence of the light chain variable region of antibody clone #5-43
SEQ ID NO: 271: Amino acid sequence of the light chain variable region of antibody clone #5-43
SEQ ID NO: 272: Nucleic acid sequence of the heavy chain variable region of antibody clone #5-43
SEQ ID NO: 273: Amino acid sequence of the heavy chain variable region of antibody clone #5-43
SEQ ID NO: 274: Nucleic acid sequence of the light chain variable region of antibody clone #6-55
SEQ ID NO: 275: Amino acid sequence of the light chain variable region of antibody clone #6-55
SEQ ID NO: 276: Nucleic acid sequence of the heavy chain variable region of antibody clone #6-55
SEQ ID NO: 277: Amino acid sequence of the heavy chain variable region of antibody clone #6-55
SEQ ID NO: 278: Nucleic acid sequence of the light chain variable region of antibody clone #7-34
SEQ ID NO: 279: Amino acid sequence of the light chain variable region of antibody clone #7-34
SEQ ID NO: 280: Nucleic acid sequence of the heavy chain variable region of antibody clone #7-34
SEQ ID NO: 281: Amino acid sequence of the heavy chain variable region of antibody clone #7-34
SEQ ID NO: 282: Nucleic acid sequence of the light chain variable region of antibody clone #8-1
SEQ ID NO: 283: Amino acid sequence of the light chain variable region of antibody clone #8-1
SEQ ID NO: 284: Nucleic acid sequence of the heavy chain variable region of antibody clone #8-1
SEQ ID NO: 285: Amino acid sequence of the heavy chain variable region of antibody clone #8-1
SEQ ID NO: 286: Nucleic acid sequence of the light chain variable region of antibody clone #8-4
SEQ ID NO: 287: Amino acid sequence of the light chain variable region of antibody clone #8-4
SEQ ID NO: 288: Nucleic acid sequence of the heavy chain variable region of antibody clone #8-4
SEQ ID NO: 289: Amino acid sequence of the heavy chain variable region of antibody clone #8-4
SEQ ID NO: 290: Nucleic acid sequence of the light chain variable region of antibody clone #8-7
SEQ ID NO: 291: Amino acid sequence of the light chain variable region of antibody clone #8-7
SEQ ID NO: 292: Nucleic acid sequence of the heavy chain variable region of antibody clone #8-7
SEQ ID NO: 293: Amino acid sequence of the heavy chain variable region of antibody clone #8-7
SEQ ID NO: 294: Nucleic acid sequence of the light chain variable region of antibody clone #8-8
SEQ ID NO: 295: Amino acid sequence of the light chain variable region of antibody clone #8-8
SEQ ID NO: 296: Nucleic acid sequence of the heavy chain variable region of antibody clone #8-8
SEQ ID NO: 297: Amino acid sequence of the heavy chain variable region of antibody clone #8-8
SEQ ID NO: 298: Nucleic acid sequence of the light chain variable region of antibody clone #7
SEQ ID NO: 299: Amino acid sequence of the light chain variable region of antibody clone #7
SEQ ID NO: 300: Nucleic acid sequence of the heavy chain variable region of antibody clone #7
SEQ ID NO: 301: Amino acid sequence of the heavy chain variable region of antibody clone #7
SEQ ID NO: 302: Nucleic acid sequence of the light chain variable region of antibody clone #10
SEQ ID NO: 303: Amino acid sequence of the light chain variable region of antibody clone #10
SEQ ID NO: 304: Nucleic acid sequence of the heavy chain variable region of antibody clone #10
SEQ ID NO: 305: Amino acid sequence of the heavy chain variable region of antibody clone #10
SEQ ID NO: 306: Nucleic acid sequence of the light chain variable region of antibody clone #13
SEQ ID NO: 307: Amino acid sequence of the light chain variable region of antibody clone #13
SEQ ID NO: 308: Nucleic acid sequence of the heavy chain variable region of antibody clone #13
SEQ ID NO: 309: Amino acid sequence of the heavy chain variable region of antibody clone #13
SEQ ID NO: 310: Nucleic acid sequence of the light chain variable region of antibody clone #22
SEQ ID NO: 311: Amino acid sequence of the light chain variable region of antibody clone #22
SEQ ID NO: 312: Nucleic acid sequence of the heavy chain variable region of antibody clone #22
SEQ ID NO: 313: Amino acid sequence of the heavy chain variable region of antibody clone #22
SEQ ID NO: 314: Nucleic acid sequence of the light chain variable region of antibody clone #33
SEQ ID NO: 315: Amino acid sequence of the light chain variable region of antibody clone #33
SEQ ID NO: 316: Nucleic acid sequence of the heavy chain variable region of antibody clone #33
SEQ ID NO: 317: Amino acid sequence of the heavy chain variable region of antibody clone #33
SEQ ID NO: 318: Nucleic acid sequence of FSTL1 used in Examples (human; human FSTL1 gene after codon optimization+sequence with sequences for recombination added at both ends+C-terminally 3×alanine+6×histidine-added sequence)

SEQ ID NO: 319: Amino acid sequence of FSTL1 used in Examples (human; human FSTL1 gene after codon optimization+sequence with sequences for recombination added at both ends+C-terminally 3×alanine+6×histidine-added sequence)
SEQ ID NO: 320: Nucleic acid sequence of FSTL1 used in Examples (mouse; mouse FSTL1 gene after codon optimization+sequence with sequences for recombination added at both ends+C-terminally 3×alanine+6×histidine-added sequence)
SEQ ID NO: 321: Amino acid sequence of FSTL1 used in Examples (mouse; mouse FSTL1 gene after codon optimization+sequence with sequences for recombination (red) added at both ends+C-terminally 3×alanine+6×histidine-added sequence)
SEQ ID NO: 322: MCS sequence
SEQ ID NO: 323: MCS sequence (complementary chain)
SEQ ID NO: 324: Sequence for insertion
SEQ ID NO: 325: Sequence for insertion
SEQ ID NO: 326: Δ21-53 (Forward primer)
SEQ ID NO: 327: Δ21-53 (Reverseprimer)
SEQ ID NO: 328: Δ100-140 (Forward primer)
SEQ ID NO: 329: Δ100-140 (Reverseprimer)
SEQ ID NO: 330: Δ148-170 (Forward primer)
SEQ ID NO: 331: Δ148-170 (Reverseprimer)
SEQ ID NO: 332: Δ181-190 (Forward primer)
SEQ ID NO: 333: Δ181-190 (Reverseprimer)
SEQ ID NO: 334: Δ193-228 (Forward primer)
SEQ ID NO: 335: Δ193-228 (Reverseprimer)
SEQ ID NO: 336: Δ233-289 (Forward primer)
SEQ ID NO: 337: Δ233-289 (Reverseprimer)
SEQ ID NO: 338: Δ148-154 (Forward primer)
SEQ ID NO: 339: Δ148-154 (Reverse primer)
SEQ ID NO: 340: Δ155-162 (Forward primer)
SEQ ID NO: 341: Δ155-162 (Reverse primer)
SEQ ID NO: 342: Δ163-170 (Forward primer)
SEQ ID NO: 343: Δ163-170 (Reverse primer)
SEQ ID NO: 344: Full-length nucleic acid sequence of the light chain of antibody clone #5-2
SEQ ID NO: 345: Full-length amino acid sequence of the light chain of antibody clone #5-2
SEQ ID NO: 346: Full-length nucleic acid sequence of the heavy chain of antibody clone #5-2
SEQ ID NO: 347: Full-length amino acid sequence of the heavy chain of antibody clone #5-2
SEQ ID NO: 348: Full-length nucleic acid sequence of the light chain of antibody clone #5-3
SEQ ID NO: 349: Full-length amino acid sequence of the light chain of antibody clone #5-3
SEQ ID NO: 350: Full-length nucleic acid sequence of the heavy chain of antibody clone #5-3
SEQ ID NO: 351: Full-length amino acid sequence of the heavy chain of antibody clone #5-3
SEQ ID NO: 352: Full-length nucleic acid sequence of the light chain of antibody clone #5-8
SEQ ID NO: 353: Full-length amino acid sequence of the light chain of antibody clone #5-8
SEQ ID NO: 354: Full-length nucleic acid sequence of the heavy chain of antibody clone #5-8
SEQ ID NO: 355: Full-length amino acid sequence of the heavy chain of antibody clone #5-8
SEQ ID NO: 356: Full-length nucleic acid sequence of the light chain of antibody clone #5-10
SEQ ID NO: 357: Full-length amino acid sequence of the light chain of antibody clone #5-10
SEQ ID NO: 358: Full-length nucleic acid sequence of the heavy chain of antibody clone #5-10
SEQ ID NO: 359: Full-length amino acid sequence of the heavy chain of antibody clone #5-10
SEQ ID NO: 360: Full-length nucleic acid sequence of the light chain of antibody clone #5-43
SEQ ID NO: 361: Full-length amino acid sequence of the light chain of antibody clone #5-43
SEQ ID NO: 362: Full-length nucleic acid sequence of the heavy chain of antibody clone #5-43
SEQ ID NO: 363: Full-length amino acid sequence of the heavy chain of antibody clone #5-43
SEQ ID NO: 364: Full-length nucleic acid sequence of the light chain of antibody clone #6-55
SEQ ID NO: 365: Full-length amino acid sequence of the light chain of antibody clone #6-55
SEQ ID NO: 366: Full-length nucleic acid sequence of antibody clone #6-55
SEQ ID NO: 367: Full-length amino acid sequence of antibody clone #6-55
SEQ ID NO: 368: Full-length nucleic acid sequence of the light chain of antibody clone #7-34
SEQ ID NO: 369: Full-length amino acid sequence of the light chain of antibody clone #7-34
SEQ ID NO: 370: Full-length nucleic acid sequence of the heavy chain of antibody clone #7-34
SEQ ID NO: 371: Full-length amino acid sequence of the heavy chain of antibody clone #7-34
SEQ ID NO: 372: Full-length nucleic acid sequence of the light chain of antibody clone #8-1
SEQ ID NO: 373: Full-length amino acid sequence of the light chain of antibody clone #8-1
SEQ ID NO: 374: Full-length nucleic acid sequence of the heavy chain of antibody clone #8-1
SEQ ID NO: 375: Full-length amino acid sequence of the heavy chain of antibody clone #8-1
SEQ ID NO: 376: Full-length nucleic acid sequence of the light chain of antibody clone #8-4
SEQ ID NO: 377: Full-length amino acid sequence of the light chain of antibody clone #8-4
SEQ ID NO: 378: Full-length nucleic acid sequence of the heavy chain of antibody clone #8-4
SEQ ID NO: 379: Full-length amino acid sequence of the heavy chain of antibody clone #8-4
SEQ ID NO: 380: Full-length nucleic acid sequence of the light chain of antibody clone #8-7
SEQ ID NO: 381: Full-length amino acid sequence of the light chain of antibody clone #8-7
SEQ ID NO: 382: Full-length nucleic acid sequence of the heavy chain of antibody clone #8-7
SEQ ID NO: 383: Full-length amino acid sequence of the heavy chain of antibody clone #8-7
SEQ ID NO: 384: Full-length nucleic acid sequence of the light chain of antibody clone #8-8
SEQ ID NO: 385: Full-length amino acid sequence of the light chain of antibody clone #8-8
SEQ ID NO: 386: Full-length nucleic acid sequence of the heavy chain of antibody clone #8-8
SEQ ID NO: 387: Full-length amino acid sequence of the heavy chain of antibody clone #8-8
SEQ ID NO: 388: Full-length nucleic acid sequence of the light chain of antibody clone #7
SEQ ID NO: 389: Full-length amino acid sequence of the light chain of antibody clone #7
SEQ ID NO: 390: Full-length nucleic acid sequence of the heavy chain of antibody clone #7
SEQ ID NO: 391: Full-length amino acid sequence of the heavy chain of antibody clone #7

SEQ ID NO: 392: Full-length nucleic acid sequence of the light chain of antibody clone #10
SEQ ID NO: 393: Full-length amino acid sequence of the light chain of antibody clone #10
SEQ ID NO: 394: Full-length nucleic acid sequence of the heavy chain of antibody clone #10
SEQ ID NO: 395: Full-length amino acid sequence of the heavy chain of antibody clone #10
SEQ ID NO: 396: Full-length nucleic acid sequence of the light chain of antibody clone #13
SEQ ID NO: 397: Full-length amino acid sequence of the light chain of antibody clone #13
SEQ ID NO: 398: Full-length nucleic acid sequence of the heavy chain of antibody clone #13
SEQ ID NO: 399: Full-length amino acid sequence of the heavy chain of antibody clone #13
SEQ ID NO: 400: Full-length nucleic acid sequence of the light chain of antibody clone #22
SEQ ID NO: 401: Full-length amino acid sequence of the light chain of antibody clone #22
SEQ ID NO: 402: Full-length nucleic acid sequence of the heavy chain of antibody clone #22
SEQ ID NO: 403: Full-length amino acid sequence of the heavy chain of antibody clone #22
SEQ ID NO: 404: Full-length nucleic acid sequence of the light chain of antibody clone #33
SEQ ID NO: 405: Full-length amino acid sequence of the light chain of antibody clone #33
SEQ ID NO: 406: Full-length nucleic acid sequence of the heavy chain of antibody clone #33
SEQ ID NO: 407: Full-length amino acid sequence of the heavy chain of antibody clone #33
SEQ ID NO: 408: Amino acid sequence of FSTL1 of Novoprotein
SEQ ID NO: 409: Nucleic acid sequence of framework 1 of the H(1) heavy chain of a humanized sequence
SEQ ID NO: 410: Amino acid sequence of framework 1 of the H(1) heavy chain of the humanized sequence
SEQ ID NO: 411: Nucleic acid sequence of framework 2 of the H(1) heavy chain of the humanized sequence
SEQ ID NO: 412: Amino acid sequence of framework 2 of the H(1) heavy chain of the humanized sequence
SEQ ID NO: 413: Nucleic acid sequence of framework 3 of the H(1) heavy chain of the humanized sequence
SEQ ID NO: 414: Amino acid sequence of framework 3 of the H(1) heavy chain of the humanized sequence
SEQ ID NO: 415: Nucleic acid sequence of framework 4 of the H(1) heavy chain of the humanized sequence
SEQ ID NO: 416: Amino acid sequence of framework 4 of the H(1) heavy chain of the humanized sequence
SEQ ID NO: 417: Nucleic acid sequence of framework 1 of the H(2) heavy chain of a humanized sequence
SEQ ID NO: 418: Amino acid sequence of framework 1 of the H(2) heavy chain of the humanized sequence
SEQ ID NO: 419: Nucleic acid sequence of framework 2 of the H(2) heavy chain of the humanized sequence
SEQ ID NO: 420: Amino acid sequence of framework 2 of the H(2) heavy chain of the humanized sequence
SEQ ID NO: 421: Nucleic acid sequence of framework 3 of the H(2) heavy chain of the humanized sequence
SEQ ID NO: 422: Amino acid sequence of framework 3 of the H(2) heavy chain of the humanized sequence
SEQ ID NO: 423: Nucleic acid sequence of framework 4 of the H(2) heavy chain of the humanized sequence
SEQ ID NO: 424: Amino acid sequence of framework 4 of the H(2) heavy chain of the humanized sequence
SEQ ID NO: 425: Nucleic acid sequence of framework 1 of the H(3) heavy chain of a humanized sequence
SEQ ID NO: 426: Amino acid sequence of framework 1 of the H(3) heavy chain of the humanized sequence
SEQ ID NO: 427: Nucleic acid sequence of framework 2 of the H(3) heavy chain of the humanized sequence
SEQ ID NO: 428: Amino acid sequence of framework 2 of the H(3) heavy chain of the humanized sequence
SEQ ID NO: 429: Nucleic acid sequence of framework 3 of the H(3) heavy chain of the humanized sequence
SEQ ID NO: 430: Amino acid sequence of framework 3 of the H(3) heavy chain of the humanized sequence
SEQ ID NO: 431: Nucleic acid sequence of framework 4 of the H(3) heavy chain of the humanized sequence
SEQ ID NO: 432: Amino acid sequence of framework 4 of the H(3) heavy chain of the humanized sequence
SEQ ID NO: 433: Nucleic acid sequence of framework 1 of the L(1) light chain of a humanized sequence
SEQ ID NO: 434: Amino acid sequence of framework 1 of the L(1) light chain of the humanized sequence
SEQ ID NO: 435: Nucleic acid sequence of framework 2 of the L(1) light chain of the humanized sequence
SEQ ID NO: 436: Amino acid sequence of framework 2 of the L(1) light chain of the humanized sequence
SEQ ID NO: 437: Nucleic acid sequence of framework 3 of the L(1) light chain of the humanized sequence
SEQ ID NO: 438: Amino acid sequence of framework 3 of the L(1) light chain of the humanized sequence
SEQ ID NO: 439: Nucleic acid sequence of framework 4 of the L(1) light chain of the humanized sequence
SEQ ID NO: 440: Amino acid sequence of framework 4 of the L(1) light chain of the humanized sequence
SEQ ID NO: 441: Full-length nucleic acid sequence of the IgG1-type H(1) heavy chain of a humanized sequence
SEQ ID NO: 442: Full-length amino acid sequence of the IgG1-type H(1) heavy chain of the humanized sequence
SEQ ID NO: 443: Full-length nucleic acid sequence of the IgG1-type H(2) heavy chain of a humanized sequence
SEQ ID NO: 444: Full-length amino acid sequence of the IgG1-type H(2) heavy chain of the humanized sequence
SEQ ID NO: 445: Full-length nucleic acid sequence of the IgG1-type H(3) heavy chain of a humanized sequence
SEQ ID NO: 446: Full-length amino acid sequence of the IgG1-type H(3) heavy chain of the humanized sequence
SEQ ID NO: 447: Full-length nucleic acid sequence of the IgG4-type H(1) heavy chain of a humanized sequence
SEQ ID NO: 448: Full-length amino acid sequence of the IgG4-type H(1) heavy chain of the humanized sequence
SEQ ID NO: 449: Full-length nucleic acid sequence of the IgG4 H(2) heavy chain of a humanized sequence
SEQ ID NO: 450: Full-length amino acid sequence of the IgG4 H(2) heavy chain of the humanized sequence
SEQ ID NO: 451: Full-length nucleic acid sequence of the IgG4 H(3) heavy chain of a humanized sequence
SEQ ID NO: 452: Full-length amino acid sequence of the IgG4 H(3) heavy chain of the humanized sequence
SEQ ID NO: 453: Full-length nucleic acid sequence of the L(1) light chain of a humanized sequence
SEQ ID NO: 454: Full-length amino acid sequence of the L(1) light chain of a humanized sequence
SEQ ID NO: 455: Amino acid sequence of heavy chain sequence framework 1 of a chicken sequence for reference
SEQ ID NO: 456: Amino acid sequence of heavy chain sequence framework 2 of the chicken sequence for reference
SEQ ID NO: 457: Amino acid sequence of heavy chain sequence framework 3 of the chicken sequence for reference SEQ ID NO: 458: Amino acid sequence of heavy chain sequence framework 4 of the chicken sequence for reference
SEQ ID NO: 459: Amino acid sequence of light chain sequence framework 1 of the chicken sequence for reference
SEQ ID NO: 460: Amino acid sequence of light chain sequence framework 2 of the chicken sequence for reference
SEQ ID NO: 461: Amino acid sequence of light chain sequence framework 3 of the chicken sequence for reference
SEQ ID NO: 462: Amino acid sequence of light chain sequence framework 4 of the chicken sequence for reference
SEQ ID NO: 463: Alternative amino acid sequence of light chain sequence framework 2 of the chicken sequence for reference
SEQ ID NO: 464: Alternative amino acid sequence of light chain sequence framework 3 of the chicken sequence for reference
SEQ ID NO: 465: Δ193-204 (Forward primer)
SEQ ID NO: 466: Δ193-204 (Reverse primer)
SEQ ID NO: 467: Δ205-216 (Forward primer)
SEQ ID NO: 468: Δ205-216 (Reverse primer)
SEQ ID NO: 469: Δ217-228 (Forward primer)
SEQ ID NO: 470: Δ217-228 (Reverse primer)
SEQ ID NO: 471: Δ233-251 (Forward primer)
SEQ ID NO: 472: Δ233-251 (Reverse primer)
SEQ ID NO: 473: Δ252-270 (Forward primer)
SEQ ID NO: 474: Δ252-270 (Reverse primer)
SEQ ID NO: 475: Δ271-289 (Forward primer)
SEQ ID NO: 476: Δ271-289 (Reverse primer)
SEQ ID NO: 477: Δ48-100 (Forward primer)
SEQ ID NO: 478: Δ48-100 (Reverse primer)
SEQ ID NO: 479: Nucleic acid sequence of framework 1 of the L(2) light chain of a humanized sequence
SEQ ID NO: 480: Amino acid sequence of framework 1 of the L(2) light chain of the humanized sequence
SEQ ID NO: 481: Nucleic acid sequence of framework 2 of the L(2) light chain of the humanized sequence
SEQ ID NO: 482: Amino acid sequence of framework 2 of the L(2) light chain of the humanized sequence
SEQ ID NO: 483: Nucleic acid sequence of framework 3 of the L(2) light chain of the humanized sequence
SEQ ID NO: 484: Amino acid sequence of framework 3 of the L(2) light chain of the humanized sequence
SEQ ID NO: 485: Nucleic acid sequence of framework 4 of the L(2) light chain of the humanized sequence
SEQ ID NO: 486: Amino acid sequence of framework 4 of the L(2) light chain of the humanized sequence
SEQ ID NO: 487: Nucleic acid sequence of framework 1 of the L(3) light chain of humanized sequence
SEQ ID NO: 488: Amino acid sequence of framework 1 of the L(3) light chain of humanized sequence
SEQ ID NO: 489: Nucleic acid sequence of framework 2 of the L(3) light chain of humanized sequence
SEQ ID NO: 490: Amino acid sequence of framework 2 of the L(3) light chain of humanized sequence
SEQ ID NO: 491: Nucleic acid sequence of framework 3 of the L(3) light chain of humanized sequence
SEQ ID NO: 492: Amino acid sequence of framework 3 of the L(3) light chain of humanized sequence
SEQ ID NO: 493: Nucleic acid sequence of framework 4 of the L(3) light chain of humanized sequence
SEQ ID NO: 494: Amino acid sequence of framework 4 of the L(3) light chain of humanized sequence
SEQ ID NO: 495: Full-length nucleic acid sequence of the L(2) light chain of the humanized sequence
SEQ ID NO: 496: Full-length amino acid sequence of the L(2) light chain of the humanized sequence
SEQ ID NO: 497: Full-length nucleic acid sequence of the L(3) light chain of the humanized sequence
SEQ ID NO: 498: Full-length amino acid sequence of the L(3) light chain of the humanized sequence
SEQ ID NO: 499: Nucleic acid sequence of human PD-L1
SEQ ID NO: 500: Amino acid sequence of human PD-L1
SEQ ID NO: 501: Nucleic acid sequence of mouse PD-L1
SEQ ID NO: 502: Amino acid sequence of mouse PD-L1
<Part 3>

TECHNICAL FIELD

The present invention relates to a combination drug for treatment of malignant tumor, etc.

BACKGROUND ART

Immunosuppression has been known as a cause of aggravation of cancer. The mitigation of immunosuppression reportedly leads to the effective treatment of cancer. Thus, approaches therefor are under development.

Patent Literature 1 has reported molecules associated with the mitigation of immunosuppression. Although FSTL1 has been studied to some extent (Non Patent Literatures 1 and 2), much is still unknown about its functions.

Techniques of the mitigation of immunosuppression are still evolving. Cancer patients have in vivo host immunity, which attempts to attack and eliminate cancer. On the other hand, cancer cells are known to possess a system that attempts to circumvent control of the host immunity. For example, it has been found in vitro and in vivo that immune response to cancer cells is changed by removing regulatory T cells in the presence of the cancer cells (see Non Patent Literature 3=Andaloussi and Lesniak Neuro-Oncology 8, 234-243, 2006). Regulatory T cells increase in number in stomach cancer (see Non Patent Literature 4=Ichihara et al., Clin. Cancer Res. 9, 4404-4408, 2003; and Non Patent Literature 5=Wolf et al., Clin. Cancer Res. 9, 606-612, 2003), rectal cancer (see Non Patent Literature 6=Hicky et al., Semin. Immunol. 11, 125-137, 1999), pancreatic cancer (see Non Patent Literature 7=Liyanage et al., J. Immunol. 169, 2756-2761, 2002; and Non Patent Literature 8=Sasada et al., Cancer 98, 1098-1099, 2003), lung cancer (see Non Patent Literature 9=Woo et al., Cancer Res. 61, 4766-4772, 2001), and glioma (see Non Patent Literature 3=Andaloussi and Lesniak Neuro-Oncology 8, 234-243, 2006), suggesting that the regulatory T cells are involved in the immune escape system of cancer cells. However, the mechanism underlying this is unknown, and the manner in which regulatory T cell-derived cytokines contribute remains a subject of dispute (see Non Patent Literature 3).

Deficiency in regulatory T cells causes serious autoimmune diseases (see Non Patent Literature 10=Sakaguchi et al., Immunol. Rev. 182, 18-32, 2001), suggesting that autoimmunity and cancer immunity have a common mechanism (see Non Patent Literature 11=Turk et al., Immunol. Rev. 188, 122-135, 2002). As mentioned above, regulatory T cells are known to participate not only in the immunosuppression of cancer cells but in exaggerated immune response such as autoimmunity or allergic reaction, through the suppression of immune response (see Non Patent Literature 12=Miyara and Sakaguchi Trends Mol. Med. 13, 108-116, 2007).

Against this backdrop, drugs for mitigation of immunosuppression currently under development are designed to remove some immunosuppressive cell populations, such as regulatory T cells or regulatory dendritic cells, or to inhibit their functions. Therefore, under the present circumstance, these drugs must be used in combination for modifying the whole immune system and are reportedly not much effective in actuality.

CITATION LIST

Patent Literature

[Patent Literature 1] International Publication No. WO2009/028411

Non Patent Literature

[Non Patent Literature 1] Cancer Research 73 (20); 6185-93, 2013
[Non Patent Literature 2] OncoImmunology 2: 11, e26528, 2013
[Non Patent Literature 3] Andaloussi and Lesniak Neuro-Oncology 8, 234-243, 2006
[Non Patent Literature 4] Ichihara et al. Clin.Cancer Res. 9, 4404-4408, 2003
[Non Patent Literature 5] Wolf et al. Clin.Cancer Res. 9, 606-612, 2003
[Non Patent Literature 6] Hicky et al. Semin. Immunol. 11, 125-137, 1999
[Non Patent Literature 7] Liyanage et al. J. Immunol. 169, 2756-2761, 2002
[Non Patent Literature 8] Sasada et al. Cancer 98, 1098-1099, 2003
[Non Patent Literature 9] Woo et al. Cancer Res. 61, 4766-4772, 2001
[Non Patent Literature 10] Sakaguchi et al. Immunol. Rev. 182, 18-32, 2001
[Non Patent Literature 11] Turk et al. Immunol. Rev. 188, 122-135, 2002
[Non Patent Literature 12] Miyara and Sakaguchi Trends Mol. Med. 13, 108-116, 2007

SUMMARY OF INVENTION

Solution to Problem

The present inventors have conducted diligent studies and consequently completed the present invention by finding out that: FSTL1 is a more promising target for the mitigation of immunosuppression; and the inhibition of the activity of FSTL1 is effective against the induction or growth of cancer-associated mesenchymal stem cells (MSCs) inducing immunosuppression considered to be partly responsible for the aggravation of cancer, and further against the acquirement of metastatic properties, particularly, bone metastatic properties, by cancer cells, and is remarkably effective for eliminating cancer. In the present invention, it has been found that FSTL1 can induce MSCs inducing immunosuppressive cells such as regulatory T cells, regulatory dendritic cells, tolerogenic dendritic cells, or myeloid-derived suppressor cells. Hence, it has been found that: upstream inhibition thereof may mitigate the whole mechanism of immunosuppression; and such an inhibitor is available as an effective anticancer agent. Thus, the present invention should receive attention, particularly, from the viewpoint that it is expected that cancer can be eliminated from living bodies more effectively than conventional methods by both "inhibition of MSCs inducing immune defect such as immunosuppression or immunodeficiency" and "inhibition of the metastatic properties of cancer cells". On the basis of these findings, the present inventors have further continued development and completed the present invention by further finding that the combination of an anti-FSTL1 antibody and an anti-CTLA4 antibody has unexpectedly remarkable therapeutic effects.

Thus, the present invention provides the following.
(1) A combination product of a FSTL1 suppressor and a CTLA4 suppressor.
(2) The combination product according to item 1, wherein the FSTL1 suppressor and the CTLA4 suppressor are each independently selected from the group consisting of an antibody, an antigen binding fragment thereof, a derivative of the antibody or the fragment, a functional equivalent, an antisense nucleic acid, siRNA, an aptamer, and a ribozyme, and a complex thereof.
(3) The combination product according to item 1 or 2, wherein the FSTL1 suppressor is an anti-FSTL1 antibody or a fragment or functional equivalent thereof, and the CTLA4 suppressor is an anti-CTLA4 antibody or a fragment or functional equivalent thereof.
(4) A combination product of an anti-FSTL1 antibody or a fragment or functional equivalent thereof and an anti-CTLA4 antibody or a fragment or functional equivalent thereof.
(5) The combination product according to item 3 or 4, wherein the anti-FSTL1 antibody recognizes an epitope in a region selected from the group consisting of amino acid positions 48 to 100, 148 to 162, 193 to 216, 205 to 228, and 272 to 289 of SEQ ID NO: 503 (amino acid sequence of human FSTL1).
(6) The combination product according to any one of items 3 to 5, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570).
(7) The combination product according to any one of items 3 to 6, wherein the anti-FSTL1 antibody comprises the full-length variable regions of an antibody selected from the group consisting of antibody #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570).
(8) The combination product according to any one of items 3 to 7, wherein the anti-FSTL1 antibody comprises a full-length antibody selected from the group consisting of antibody #6-55 (light chain: SEQ ID NO: 618; heavy chain: SEQ ID NO: 620), #7-34 (light chain: SEQ ID NO: 622; heavy chain: SEQ ID NO: 624), #8-1 (light chain: SEQ ID NO: 626; heavy chain: SEQ ID NO: 628), #7 (light chain: SEQ ID NO: 642; heavy chain: SEQ ID NO: 644), #10 (light chain: SEQ ID NO: 556; heavy chain: SEQ ID NO: 558), #13 (light chain: SEQ ID NO: 650; heavy chain: SEQ ID NO: 652) and #33 (light chain: SEQ ID NO: 658; heavy chain: SEQ ID NO: 660).

or a humanized sequence thereof.

(9) The combination product according to any one of items 3 to 8, wherein the anti-CTLA4 antibody has the ability to inhibit the binding between CTLA4 and CD80 and/or CD86.

(10) The combination product according to any one of items 3 to 9, wherein the anti-CTLA4 antibody comprises the heavy chain CDR1 (positions 31 to 35 of SEQ ID NO: 756), heavy chain CDR2 (positions 50 to 66 of SEQ ID NO: 756), heavy chain CDR3 (positions 99 to 107 of SEQ ID NO: 756), light chain CDR1 (positions 24 to 35 of SEQ ID NO: 757), light chain CDR2 (positions 51 to 57 of SEQ ID NO: 757), and light chain CDR3 (positions 90 to 97 of SEQ ID NO: 757) of antibody clone 9H10 (BioLegend, Inc.) or ipilimumab.

(11) The combination product according to any one of items 3 to 10, wherein the anti-CTLA4 antibody comprises the full-length variable regions (positions 1 to 118 of a heavy chain (SEQ ID NO: 756) and positions 1 to 110 of a light chain (SEQ ID NO: 757)) of antibody clone 9H10 or ipilimumab.

(12) The combination product according to any one of items 3 to 11, wherein the anti-CTLA4 antibody comprises full-length antibody clone 9H10 or ipilimumab (SEQ ID NO: 756 and SEQ ID NO: 757) or a humanized sequence thereof.

(13) The combination product according to any one of items 3 to 12, wherein the anti-FSTL1 antibody is a humanized antibody.

(14) The combination product according to any one of items 3 to 13, wherein the anti-FSTL1 antibody is a humanized antibody having the H chain FR1, FR2, FR3, and FR4 (SEQ ID NOs: 671, 673, 675, and 677, respectively) and L chain FR1, FR2, FR3, and FR4 (SEQ ID NOs: 687, 689, 691, and 693, respectively) of H(2)-L(1).

(15) A medicament comprising a combination product according to any one of items 1 to 14.

(16) An anticancer agent comprising a combination product according to any one of items 1 to 14.

(17) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising a combination product according to any one of items 1 to 14.

(18) A therapeutic agent for colorectal cancer, comprising a combination product according to any one of items 1 to 14.

(19) An inhibitor of metastasis of cancer cells, comprising a combination product according to any one of items 1 to 14.

(20) An inhibitor of enhancement of immune defect by mesenchymal stem cells (MSCs), comprising a combination product according to any one of items 1 to 14.

(21) The inhibitor according to item 20, wherein the immune defect includes immunosuppression and immunodeficiency.

(22) The inhibitor according to item 20 or 21, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(23) An inhibitor of acquirement and/or enhancement of immune defect activity by or of immune-related cells, comprising a combination product according to any one of items 1 to 14.

(24) The inhibitor according to item 23, wherein the immune defect includes immunosuppression and immunodeficiency.

(25) The inhibitor according to item 23 or 24, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(26) An anticancer agent comprising an anti-FSTL1 antibody or a fragment or functional equivalent thereof, wherein the anti-FSTL1 antibody or the fragment or functional equivalent thereof is administered in combination with an anti-CTLA4 antibody or a fragment or functional equivalent thereof.

(27) An anticancer agent comprising a FSTL1 suppressor, wherein the FSTL1 suppressor is administered in combination with a CTLA4 suppressor.

(28) An anticancer agent comprising an anti-CTLA4 antibody or a fragment or functional equivalent thereof, wherein the anti-CTLA4 antibody or the fragment or functional equivalent thereof is administered in combination with an anti-FSTL1 antibody or a fragment or functional equivalent thereof.

(29) An anticancer agent comprising a CTLA4 suppressor, wherein the CTLA4 suppressor is administered in combination with a FSTL1 suppressor.

(30) The medicament according to item 16, the anticancer agent according to any of items 17 and 26 to 29, the therapeutic agent according to item 17 or 18, or the inhibitor according to any of items 19 to 25, wherein the antibody is administered intratumorally or intravenously.

In the present invention, one or more features mentioned above are intended to be combined as stated herein and be combinable in other ways. Those skilled in the art recognize further embodiments and advantages of the present invention by reading and understanding the detailed description given below, according to the need.

Advantageous Effects of Invention

The present invention effectively suppresses the metastasis of cancer cells directly by acting on the cancer cells through the inhibition of FSTL1 or indirectly by suppressing the differentiation induction and growth of immunosuppressive or immunodeficient cells such as regulatory T cells (Tregs) or myeloid-derived suppressor cells (MDSCs) which suppress immunity, and/or the growth and differentiation induction of mesenchymal stem cells (MSCs) which promote the enhancement of immunosuppressive activity or immunodeficient activity. Furthermore, the present invention effectively suppresses even cancer metastasis considered to be difficult to suppress, particularly, bone metastasis for which an effective treatment method has not yet been established. Moreover, the present invention suppresses differentiation induction of Tregs, tumor growth, metastasis, weight loss caused by emaciation, etc., not only in bone metastasis models but in various animal cancer models. Accordingly, the present invention provides a therapeutic drug for cancer effective over multiple aspects. Also, the present invention can mitigate the whole mechanism of immunosuppression or immunodeficiency as compared with conventional ones and therefore provides even an agent for mitigation of immunosuppression or mitigation of immunodeficiency for extensive use. The agent for mitigation of immunosuppression or mitigation of immunodeficiency of the present invention is not an agent that removes some immunosuppressive cell populations such as regulatory T cells or regulatory dendritic cells or inhibits their functions, and therefore circumvents broad conventional limitations to agents for mitigation of immunosuppression. Thus, the agent of the present invention is also effective against exhausted T cells. Hence, the agent of the present invention also has an immunodeficiency-mitigating effect and is also useful as an agent for mitigation of immune defect. In the present invention, it has been found as to these effects brought about by the inhibition of FSTL1 that more remarkable effects are exerted by combining the inhibition of FSTL1 and the inhibition of CTLA4. More specifically, unexpectedly, the inhibition of FSTL1 and the inhibition with an anti-CTLA4 antibody exhibited synergistic effects and enhanced an anti-tumor effect to be equal to or greater than the synergistic effects so that colorectal cancer disappeared in five out of five animals.

Description of Embodiments

Hereinafter, the embodiments of the present invention will be described in detail. Description about the same or similar contents will be appropriately omitted in order to avoid cumbersome repetition. It should be understood that the singular form of a word conceptually includes the plural form of the word throughout the present specification unless otherwise specified. Thus, it should be understood that the article of a singular noun (e.g., "a", "an", and "the") conceptually includes even the plural noun thereof unless otherwise specified. It should be understood that terms used herein have meanings usually used in the art unless otherwise specified. Thus, all technical terms and scientific terms used herein have the same meanings as those generally understood by those skilled in the art to which the present invention belongs, unless otherwise defined. If there is any contradiction, the present specification (including definitions) takes a priority.

First, the terms and general techniques used in the present invention will be described.

In the present specification, "FSTL1" gene encodes a protein with similarity to follistatin, an activin binding protein. FSTL1 contains an FS module contained in a follistatin-like sequence and reportedly has 10 conserved cysteine residues. Although the protein is thought to be an autoantigen associated with rheumatoid arthritis, recent findings are described in Patent Literature 1 (WO2009/028411). The accession numbers of FSTL1 described in NCBI are, for example, NP_009016 (NP_009016.1); NP_032073.2 (amino acid), and NM_007085 (NM_007085.4); NM_008047.5 (mRNA). The amino acid sequence of FSTL1 is represented by, for example, SEQ ID NO: 503 or SEQ ID NO: 505. The nucleotide sequence of FSTL1 mRNA is represented by, for example, SEQ ID NO: 504 or SEQ ID NO: 506. FSTL1 is not limited by its amino acid sequence as long as the protein has FSTL1 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

Thus, the typical nucleotide sequence of FSTL1 can be (a) a polynucleotide having the nucleotide sequence represented by SEQ ID NO: 503 or SEQ ID NO: 505 or a fragment sequence thereof;

(b) a polynucleotide encoding a polypeptide consisting of the amino acid sequence represented by SEQ ID NO: 504 or SEQ ID NO: 506 or a fragment thereof;

(c) a polynucleotide encoding an altered polypeptide having one mutation selected from the group consisting of substitution, addition, and deletion of one or more amino acids in the amino acid sequence represented by SEQ ID NO: 504 or SEQ ID NO: 506, or a fragment thereof, the altered polypeptide having biological activity;

(d) a polynucleotide which is a splicing variant or allelic variant of the nucleotide sequence represented by
SEQ ID NO: 503 or SEQ ID NO: 505, or a fragment thereof;

(e) a polynucleotide encoding a homolog of a polypeptide consisting of the amino acid sequence represented by SEQ ID NO: 504 or SEQ ID NO: 506, or a fragment thereof;

(f) a polynucleotide that hybridizes under stringent conditions to any one of the polynucleotides (a) to (e) and encodes a polypeptide having biological activity; or (g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.
In this context, the biological activity typically refers to activity possessed by FSTL1 or means that a marker can be differentiated from other proteins present in the same organism.

The amino acid sequence of FSTL1 can be (a) a polypeptide consisting of the amino acid sequence represented by SEQ ID NO: 504 or SEQ ID NO: 506 or a fragment thereof;

(b) a polypeptide that has one mutation selected from the group consisting of substitution, addition, and deletion of one or more amino acids in the amino acid sequence represented by SEQ ID NO: 504 or SEQ ID NO: 506, and has biological activity;

(c) a polypeptide encoded by a splicing variant or allelic variant of the nucleotide sequence represented by SEQ ID NO: 503 or SEQ ID NO: 505;

(d) a polypeptide which is a homolog of the amino acid sequence represented by SEQ ID NO: 504 or SEQ ID NO: 506; or (e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.
In this context, the biological activity typically refers to activity possessed by FSTL1 or means that a marker can be differentiated from other proteins present in the same organism (e.g., an antigen used contains a region capable of functioning as a specific epitope). SEQ ID NOs: 503 to 506 each encode or represent a precursor containing a leader sequence. The first 20 amino acids (methionine to alanine) in SEQ ID NO: 504 and the first 18 amino acids (methionine to glycine) in SEQ ID NO: 506 are leader sequences. Thus, in the present invention, the amino acid sequence of the term FSTL1 may refer to a sequence after deletion of the leader sequence.

In relation to the present invention, "substance binding to FSTL1", "FSTL1 binding agent", or "FSTL1 interacting molecule" is a molecule or a substance binding to FSTL1 at least transiently. Preferably, it is advantageous for detection to be able to display binding (e.g., to be labeled or be a labelable state), and it is advantageous for treatment to be further bound with an agent for treatment. Examples of the substance binding to FSTL1 can include antibodies, antisense oligonucleotides, siRNA, low-molecular-weight molecules (LMW), binding peptides, aptamers, ribozymes, and peptidomimetics. The substance binding to FSTL1 or the "FSTL1 interacting molecule may be an inhibitor of FSTL1 and also includes, for example, a binding protein or a binding peptide directed to FSTL1, particularly, directed to an active site of FSTL1, and a nucleic acid directed to the FSTL1 gene. The nucleic acid against FSTL1 refers to, for example, double-stranded or single-stranded DNA or RNA inhibiting the expression of the FSTL1 gene or the activity of FSTL1, or a modified form or derivative thereof, and further includes, but is not limited to, an antisense nucleic acid, an aptamer, siRNA (small interfering RNA), and a ribozyme. In the present specification, "binding protein" or "binding peptide" as to FSTL1 refers to an arbitrary protein or peptide binding to FSTL1 and further includes, but is not limited to, an antibody (e.g., a polyclonal antibody or a monoclonal antibody), an antibody fragment, and a functional equivalent directed to FSTL1.

In the present specification, "CTLA4" and "CTLA-4" are used interchangeably. CTLA4, also called CD152, is a 40-kDa member of the immunoglobulin superfamily. CTLA4 is expressed on the surface of helper T cells, transduces inhibitory signals to T cells, and binds to CD80 and CD86. CTLA-4 is named after the 4th cytotoxic T lymphocyte-associated antigen. The accession numbers of CTLA4 described in NCBI are, for example, NP_001032720 (amino acid) for humans; NP_001268905 (amino acid) for mice, and NM_001037631 (mRNA) for humans; NM_001281976 (mRNA) for mice. The amino acid sequence of CTLA4 is represented by, for example, SEQ ID NO: 752 or SEQ ID NO: 754. The nucleotide sequence of CTLA4 mRNA is represented by, for example, SEQ ID NO: 753 or SEQ ID NO: 755. CTLA4 is not limited by its amino acid sequence as long as the protein has CTLA4 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

Thus, the typical nucleotide sequence of CTLA4 can be (a) a polynucleotide having the nucleotide sequence represented by SEQ ID NO: 752 or SEQ ID NO: 754 or a fragment sequence thereof;

(b) a polynucleotide encoding a polypeptide consisting of the amino acid sequence represented by SEQ ID NO: 753 or SEQ ID NO: 755 or a fragment thereof;

(c) a polynucleotide encoding an altered polypeptide having one mutation selected from the group consisting of substitution, addition, and deletion of one or more amino acids in the amino acid sequence represented by SEQ ID NO: 753 or SEQ ID NO: 755, or a fragment thereof, the altered polypeptide having biological activity;

(d) a polynucleotide which is a splicing variant or allelic variant of the nucleotide sequence represented by SEQ ID NO: 752 or SEQ ID NO: 754, or a fragment thereof;

(e) a polynucleotide encoding a homolog of a polypeptide consisting of the amino acid sequence represented by SEQ ID NO: 753 or SEQ ID NO: 755, or a fragment thereof;

(f) a polynucleotide that hybridizes under stringent conditions to any one of the polynucleotides (a) to (e) and encodes a polypeptide having biological activity; or (g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.

In this context, the biological activity typically refers to activity possessed by CTLA4 or means that a marker can be differentiated from other proteins present in the same organism.

The amino acid sequence of CTLA4 can be (a) a polypeptide consisting of the amino acid sequence represented by SEQ ID NO: 753 or SEQ ID NO: 755 or a fragment thereof;

(b) a polypeptide that has one mutation selected from the group consisting of substitution, addition, and deletion of one or more amino acids in the amino acid sequence represented by SEQ ID NO: 753 or SEQ ID NO: 755, and has biological activity;

(c) a polypeptide encoded by a splicing variant or allelic variant of the nucleotide sequence represented by SEQ ID NO: 752 or SEQ ID NO: 754;

(d) a polypeptide which is a homolog of the amino acid sequence represented by SEQ ID NO: 753 or SEQ ID NO: 755; or (e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.

In this context, the biological activity typically refers to activity possessed by PD-L1 or means that a marker can be differentiated from other proteins present in the same organism (e.g., an antigen used contains a region capable of functioning as a specific epitope). SEQ ID NOs: 752 to 755 each encode or represent a precursor containing a leader sequence. The first 35 amino acids in both SEQ ID NOs: 753 and 755 (methionine to cysteine in SEQ ID NO: 753 and methionine to serine in SEQ ID NO: 755) are leader sequences. Thus, in the present invention, the amino acid sequence of the term CTLA4 may refer to a sequence after deletion of the leader sequence.

In relation to the present invention, "substance binding to CTLA4", "CTLA4 binding agent", or "CTLA4 interacting molecule" is a molecule or a substance binding to CTLA4 at least transiently. Preferably, it is advantageous for detection to be able to display binding (e.g., to be labeled or be a labelable state), and it is advantageous for treatment to be further bound with an agent for treatment. Examples of the substance binding to CTLA4 can include antibodies, antisense oligonucleotides, siRNA, low-molecular-weight molecules (LMW), binding peptides, aptamers, ribozymes, and peptidomimetics. The substance binding to CTLA4 or the "CTLA4 interacting molecule may be an inhibitor of CTLA4 and also includes, for example, a binding protein or a binding peptide directed to CTLA4, particularly, directed to an active site of CTLA4, and a nucleic acid directed to the CTLA4 gene. The nucleic acid against CTLA4 refers to, for example, double-stranded or single-stranded DNA or RNA inhibiting the expression of the CTLA4 gene or the activity of CTLA4, or a modified form or derivative thereof, and further includes, but is not limited to, an antisense nucleic acid, an aptamer, siRNA (small interfering RNA), and a ribozyme. In the present specification, "binding protein" or "binding peptide" as to CTLA4 refers to an arbitrary protein or peptide binding to CTLA4 and further includes, but is not limited to, an antibody (e.g., a polyclonal antibody or a monoclonal antibody), an antibody fragment, and a functional equivalent directed to CTLA4.

"Derivative", "analog", or "mutant" (or "variant") used herein preferably includes a molecule containing a region substantially homologous to the protein of interest (e.g., FSTL1 or CTLA4), though any limitation is not intended. In various embodiments, such a molecule is identical by at least 30%, 40%, 50%, 60%, 70%, 80%, 90%, 95%, or 99% over amino acid sequences of the same sizes or when compared with a sequence aligned by alignment using a computer homology program known in the art, or a nucleic acid encoding such a molecule is capable of hybridizing to a sequence encoding the constituent protein, under (highly) stringent conditions, moderately stringent conditions, or non-stringent conditions. This is a product altered from a naturally occurring protein by amino acid substitution, deletion, and/or addition, and means that the protein derivative still exhibits the biological functions of the naturally occurring protein to the same extent or not to the same extent. The biological functions of such a protein may be examined by, for example, appropriate and available in vitro assay described herein or known in the art. The phrase "functionally active" used herein means that a polypeptide, i.e., a fragment or a derivative, has the structural functions, controlling functions, or biochemical functions of the protein, such as biological activity, according to an aspect related to the polypeptide, i.e., fragment or derivative, of the present invention in the present specification. In the present invention, humans are mainly discussed about FSTL1 or CTLA4. However, many non-human animals are known to express FSTL1 or CTLA4. Therefore, it is understood that these animals, particularly, mammals, are also included in the scope of the present invention.

In the present specification, "protein", "polypeptide", "oligopeptide", and "peptide" are used herein interchangeably with each other and refer to an amino acid polymer having an arbitrary length. This polymer may be linear or branched or may be cyclic. The amino acid may be natural or non-natural or may be an altered amino acid. This term may also encompass an assembly of a plurality of polypeptide chains as a complex. This term also encompasses a naturally or artificially altered amino acid polymer. Such alteration encompasses, for example, disulfide bond formation, glycosylation, lipidation, acetylation, phosphorylation, or any other operation or alteration (e.g., conjugation with a labeling component). This definition also encompasses, for example, a polypeptide containing analogs of one or two or more amino acids (including e.g., a non-natural amino acid), a peptide-like compound (e.g., a peptoid), and other alterations known in the art. In the present specification, "amino acid" is a generic name for organic compounds having amino and carboxyl groups. When the antibody according to the embodiments of the present invention comprises "particular amino acid sequence", any amino acid in the amino acid sequence may receive chemical modification. Also, any amino acid in the amino acid sequence may form a salt or a solvate. Also, any amino acid in the amino acid sequence may be in a L- or D-form. In such cases, the protein according to the embodiments of the present invention is also interpreted to comprise the "particular amino acid sequence" described above. For example, N-terminal modification (e.g., acetylation and myristoylation), C-terminal modification (e.g., amidation and glycosylphosphatidylinositol addition), or side chain modification (e.g., phosphorylation and glycosylation) is known as the in vivo chemical modification of amino acids contained in proteins. The modification may be natural or non-natural as long as the object of the present invention is met.

In the present specification, "polynucleotide", "oligonucleotide", and "nucleic acid" are used herein interchangeably with each other and refer to a nucleotide polymer having an arbitrary length. This term also includes "oligonucleotide derivative" or "polynucleotide derivative". "Oligonucleotide derivative" or "polynucleotide derivative" refers to an oligonucleotide or a polynucleotide that contains a nucleotide derivative or has an internucleotide bond different from a usual one, and is used interchangeably. Specific examples of such an oligonucleotide include 2'-O-methyl-ribonucleotide, an oligonucleotide derivative in which a phosphodiester bond in an oligonucleotide has been converted to a phosphorothioate bond, an oligonucleotide derivative in which a phosphodiester bond in an oligonucleotide has been converted to a N3'-P5' phosphoramidate bond, an oligonucleotide derivative in which ribose and a phosphodiester bond in an oligonucleotide have been converted to a peptide nucleic acid bond, an oligonucleotide derivative in which uracil in an oligonucleotide has been replaced with C-5 propynyluracil, an oligonucleotide derivative in which uracil in an oligonucleotide has been replaced with C-5 thiazoleuracil, an oligonucleotide derivative in which cytosine in an oligonucleotide has been replaced with C-5 propynylcytosine, an oligonucleotide derivative in which cytosine in an oligonucleotide has been replaced with phenoxazine-modified cytosine, an oligonucleotide derivative in which ribose in DNA has been replaced with 2'-O-propylribose, and an oligonucleotide derivative in which ribose in an oligonucleotide has been replaced with 2'-methoxyethoxyribose. A particular nucleic acid sequence is also intended to encompass an explicitly shown sequence as well as a conservatively altered form (e.g., a degenerate codon substitution variant) and a complementary sequence thereof, unless otherwise specified. Specifically, the degenerate codon substitution variant can be achieved by preparing a sequence in which the third position of one or more selected (or all) codons has been replaced with a mixed base and/or a deoxyinosine residue (Batzer et al., Nucleic Acid Res. 19: 5081 (1991); Ohtsuka et al., J. Biol. Chem. 260: 2605-2608 (1985); and Rossolini et al., Mol. Cell. Probes 8: 91-98 (1994)). In the present specification, "nucleic acid" is also used interchangeably with a gene, cDNA, mRNA, an oligonucleotide, and a polynucleotide. In the present specification, "nucleotide" may be natural or non-natural.

In the present specification, "gene" refers to an agent that governs genetic traits. "Gene" may refer to "polynucleotide", "oligonucleotide", and "nucleic acid".

In the present specification, "homology" of genes refers to the degree of identity between two or more gene sequences. In general, having "homology" means that the degree of identity or similarity is high. Thus, as the homology of two certain genes is higher, the identity or similarity of their sequences is higher. Whether or not two types of genes have homology can be examined by the direct comparison of their sequences or hybridization under stringent conditions for nucleic acids. In the case of directly comparing two gene sequences, these genes have homology when their DNA sequences are identical by typically at least 50%, preferably at least 70%, more preferably at least 80%, 90%, 95%, 96%, 97%, 98%, or 99% between the gene sequences. Thus, in the present specification, "homolog" or "homologous gene product" means a protein of another species, preferably a mammalian protein, which exerts the same biological functions as those of a protein constituent of a complex further described herein. Such a homolog is also referred to as "ortholog gene product". It is understood that such a homolog, a homologous gene product, an ortholog gene product, or the like can also be used as long as the object of the present invention is met.

An amino acid can be mentioned herein by a generally known three-letter code thereof or a one-letter code recommended by IUPAC-IUB Biochemical Nomenclature Commission. Likewise, a nucleotide may be mentioned by a generally recognized one-letter code. In the present specification, the comparison of similarity, identity, and homology between amino acid sequences and nucleotide sequences is calculated using a tool BLAST for sequence analysis with default parameters. Identity search can be performed using, for example, NCBI BLAST 2.2.28 (issued on Apr. 2, 2013). In the present specification, the value of identity usually refers to a value obtained by alignment under default conditions using the BLAST described above. However, in the case where a higher value is obtained by change of a parameter, the highest value is used as the value of identity. In the case where identity is evaluated for a plurality of regions, the highest value thereamong is used as the value of identity. The similarity is a numerical value calculated by including similar amino acids in addition to the identity.

In one embodiment of the present invention, the term "several" may be, for example, 10, 8, 6, 5, 4, 3, or 2 or may be equal to or less than any of these values. A polypeptide that has undergone the deletion, addition, or insertion of 1 or several amino acid residues, or the substitution of 1 or several amino acid residues by other amino acids is known to maintain its biological activity (Mark et al., Proc Natl Acad Sci USA. 1984 September; 81 (18): 5662-5666; Zoller et al., Nucleic Acids Res. 1982 Oct. 25; 10 (20): 6487-6500; and Wang et al., Science. 1984 Jun. 29; 224 (4656): 1431-1433.). An antibody that has undergone deletion, etc. can be prepared by, for example, site-directed mutagenesis, random mutagenesis, or biopanning using antibody phage libraries. For example, KOD-Plus-Mutagenesis Kit (Toyobo Co., Ltd.) can be used in the site-directed mutagenesis. The selection of an antibody having activity similar to that of wild type from mutant-type antibodies in which deletion, etc. has been introduced can be achieved by various characterization techniques such as FACS analysis or ELISA.

In one embodiment of the present invention, the phrase "90% or higher" may be, for example, 90, 95, 96, 97, 98, 99, or 100% or higher and may be within the range of any two of these values. The "homology" described above may be calculated as the percentage of the number of homologous amino acids between two or more amino acid sequences according to a method known in the art. Before the calculation of the percentage, a gap is introduced to a portion of amino acid sequences, if required, in order to align the amino acid sequences of an amino acid sequence group for comparison and maximize the percentage of identical amino acids. A method for alignment, a method for calculating the percentage, a comparison method, and a computer program associated therewith have heretofore been well known in the art (e.g., BLAST and GENETYX). In the present specification, "homology" can be represented by a value measured by NCBI BLAST, unless otherwise specified. Default setting of Blastp can be used in algorithms for comparing amino acid sequences by BLAST. The measurement results are converted to numerical values as positives or identities.

In the present specification, "polynucleotide hybridizing under stringent conditions" refers to well-known conditions conventionally used in the art. Such a polynucleotide can be obtained by use of colony hybridization, plaque hybridization, Southern blot hybridization, or the like using a polynucleotide selected from among the polynucleotides of the present invention as a probe. Specifically, the polynucleotide means a polynucleotide that can be identified by hybridization at 65° C. in the presence of 0.7 to 1.0 M NaCl using a colony- or plaque-derived DNA-immobilized filter, followed by the washing of the filter under 65° C. conditions using a 0.1 to 2×SSC (saline-sodium citrate) solution (the composition of a 1×SSC solution is 150 mM sodium chloride and 15 mM sodium citrate). "Stringent conditions" can adopt, for example, the following conditions: (1) low ion strength and high temperature are used for washing (e.g., 0.015 M sodium chloride/0.0015 M sodium citrate/0.1% sodium dodecyl sulfate at 50° C.), (2) a denaturant such as formamide is used in hybridization (e.g., 50% (v/v) formamide, 0.1% bovine serum albumin/0.1% Ficoll/0.1% polyvinylpyrrolidone/50 mM sodium phosphate buffer (pH 6.5), 750 mM sodium chloride, and 75 mM sodium citrate at 42° C.), or (3) the filter is incubated overnight at 37° C. in a solution containing 20% formamide, 5×SSC, 50 mM sodium phosphate (pH 7.6), a 5×Denhardt's solution, 10% dextran sulfate, and 20 mg/ml of denatured sheared salmon sperm DNA, and then washed with 1×SSC at approximately 37 to 50° C. The formamide concentration may be 50% or higher. The washing time may be 5, 15, 30, 60, or 120 minutes or longer. A plurality of factors such as temperature and salt concentration are possible as factors that influence the stringency of hybridization reaction. For the details, see Ausubel et al., Current Protocols in Molecular Biology, Wiley Interscience Publishers, (1995). An example of "highly stringent conditions" is 0.0015 M sodium chloride and 0.0015 M sodium citrate at 65 to 68° C., or 0.015 M sodium chloride, 0.0015 M sodium citrate, and 50% formamide at 42° C. The hybridization can be performed according to a method described in an experimental manual such as Molecular Cloning 2nd ed., Current Protocols in Molecular Biology, Supplement 1-38, or DNA Cloning 1: Core Techniques, A Practical Approach, Second Edition, Oxford University Press (1995). In this context, preferably, a sequence comprising only an A sequence or only a T sequence is excluded from a sequence hybridizing under stringent conditions. Moderately stringent conditions can be readily determined by those skilled in the art on the basis of, for example, the length of DNA, and are shown in Sambrook et al., Molecular Cloning: A Laboratory Manual, 3rd ed., Vol. 1, 7.42-7.45 Cold Spring Harbor Laboratory Press, 2001. As for a nitrocellulose filter, the moderately stringent conditions include use of hybridization conditions involving a prewashing solution of 5×SSC, 0.5% SDS, and 1.0 mM EDTA (pH 8.0), and approximately 50% formamide and 2×SSC to 6×SSC at approximately 40 to 50° C. (or any other similar hybridization solution such as a Stark's solution in approximately 50% formamide at approximately 42° C.), and washing conditions involving approximately 60° C., 0.5×SSC, and 0.1% SDS. Thus, the polypeptide used in the present invention also encompasses a polypeptide encoded by a nucleic acid molecule hybridizing under highly or moderately stringent conditions to a nucleic acid molecule encoding the polypeptide particularly described in the present invention.

In the present specification, "purified" substance or biological agent (e.g., nucleic acid or protein) refers to the substance or biological agent from which at least a portion of natural accompaniments has been removed. Thus, for the purified biological agent, the purity of the biological agent is usually higher than that in a state where the biological agent is normally present (i.e., the biological agent is concentrated). The term "purified" used herein means that preferably at least 75% by weight, more preferably at least 85% by weight, still more preferably at least 95% by weight, most preferably at least 98% by weight of a homotypic biological agent is present. The substance or biological agent used in the present invention is preferably a "purified" substance. "Isolated" substance or biological agent (e.g., nucleic acid or protein) used herein refers to the substance or biological agent from which natural accompaniments have been substantially removed. The term "isolated" used herein varies depending on the purpose and therefore, is not necessarily required to be indicated by purity. If necessary, this term means that preferably at least 75% by weight, more preferably at least 85% by weight, still more preferably at least 95% by weight, most preferably at least 98% by weight of a homotypic biological agent is present. The substance used in the present invention is preferably an "isolated" substance or biological agent.

In the present specification, "corresponding" amino acid or nucleic acid, or moiety refers to an amino acid or a nucleotide having or presumed to have action similar to that of a predetermined amino acid or nucleotide, or moiety in a reference polypeptide or polynucleotide for comparison, in a certain polypeptide molecule or polynucleotide molecule (e.g., FSTL1 or CTLA4). Particularly, this term refers to an amino acid that is located at a similar position in an active site and similarly contributes to catalytic activity, for an enzyme molecule, and refers to a corresponding moiety (e.g., a transmembrane domain) for a complex molecule. For example, for an antisense molecule, the corresponding amino acid or nucleic acid, or moiety can be a similar moiety in an ortholog corresponding to a particular moiety of the antisense molecule. The corresponding amino acid can be, for example, a particular amino acid that undergoes cysteinylation, glutathionylation, S—S bond formation, oxidation (e.g., oxidation of a methionine side chain), formylation, acetylation, phosphorylation, glycosylation, myrstylation, or the like. Alternatively, the corresponding amino acid may be an amino acid in charge of dimerization. Such "corresponding" amino acid or nucleic acid may be a region or a domain that spans a given range. Thus, in such a case, the corresponding amino acid or nucleic acid is referred herein to as "corresponding" region or domain. In the present invention, such a corresponding region or domain is useful for designing a complex molecule.

In the present specification, "corresponding" gene (e.g., polynucleotide sequence or molecule) refers to a gene (e.g., polynucleotide sequence or molecule) having or presumed to have action similar to a predetermined gene in a reference species for comparison, in a certain species. In the case where a plurality of genes having such action are present, the corresponding gene refers to a gene having evolutionarily the same origin. Thus, a gene corresponding to a certain gene can be an ortholog of the gene. Thus, human FSTL1 or CTLA4 can be found as corresponding FSTL1 or CTLA4 in other animals (particularly, mammals). Such a corresponding gene can be identified by use of a technique well known in the art. Thus, for example, a corresponding gene in a certain animal (e.g., mouse) can be found by using sequences such as SEQ ID NOs: 503 to 506 or 662 to 665 as query sequences for a reference gene (e.g., FSTL1 or CTLA4) of the corresponding gene and searching a database involving the sequences of the animal.

In the present specification, "fragment" refers to a polypeptide or a polynucleotide having a sequence length of 1 to n−1 with respect to a full-length polypeptide or polynucleotide (length: n). The length of the fragment can be appropriately changed according to the purpose. Examples of the lower limit of the length of the polypeptide include 3, 4, 5, 6, 7, 8, 9, 10, 15, 20, 25, 30, 40, and 50 or more amino acids. A length represented by an integer that is not specifically listed here (e.g., 11) may also be appropriate for the lower limit. Examples of the lower limit of the length of the polynucleotide include 5, 6, 7, 8, 9, 10, 15, 20, 25, 30, 40, 50, 75, and 100 or more nucleotides. A length represented by an integer that is not specifically listed here (e.g., 11) may also be appropriate for the lower limit. In the present specification, it is understood that in the case where a full-length molecule functions as, for example, a marker or a target molecule, such a fragment is included in the scope of the present invention as long as the fragment itself also has the functions as a marker or a target molecule.

According to the present invention, the term "activity" refers to a function of a molecule in the broadest sense in the present specification. The activity generally includes a biological function, a biochemical function, a physical function, or a chemical function of the molecule, though any limitation is not intended. The activity includes, for example, enzymatic activity, the ability to interact with other molecules, the ability to activate, promote, stabilize, inhibit, suppress, or destabilize the functions of other molecules, stability, or the ability to localize to a particular intracellular position. This term also relates to a function of a protein complex in the broadest sense, if applicable.

In the present specification, "biological function" when a certain gene or a nucleic acid molecule or polypeptide related thereto is mentioned refers to a particular function that can be possessed in vivo by the gene, the nucleic acid molecule, or the polypeptide. Examples thereof can include, but are not limited to, production of a specific antibody, enzymatic activity, and conferring of resistance. In the present invention, examples thereof can include, but are not limited to, a function by which FSTL1 or CTLA4 is involved in the inhibition of VLDL uptake, etc. In the present specification, the biological function can be exerted by "biological activity". In the present specification, "biological activity" refers to activity that can be possessed in vivo by a certain agent (e.g., polynucleotide and protein). The biological activity encompasses activity that exerts various functions (e.g., transactivating activity) and also encompasses, for example, activity of interacting with a certain molecule to activate or deactivate another molecule. In the case where two agents interact with each other, the biological activity can be the binding between these two molecules and biological change caused thereby. For example, two molecules are considered to be bound with each other when an antibody is precipitated using one of the molecules and also coprecipitated with the other molecule. Thus, the examination of such coprecipitation is one judgment approach. In the case where the certain agent is, for example, an enzyme, the biological activity encompasses its enzymatic activity. In another example, in the case where the certain agent is a ligand, the biological activity encompasses the binding of the ligand to a corresponding receptor. Such biological activity can be measured by a technique well known in the art. Thus, "activity" refers to various measurable indexes that indicate or reveal binding (either directly or indirectly) or influence response (i.e., having measurable influence that responds to any exposure or stimulation). Examples thereof include the affinity of a compound binding directly to the polypeptide or the polynucleotide of the present invention, the amount of an upstream or downstream protein after some stimuli or events, and measures of other similar functions.

In the present specification, "expression" of a gene, a polynucleotide, a polypeptide, or the like means that the gene, etc. assumes a different form by given action in vivo. Preferably, this term means that the gene, the polynucleotide, etc. assumes a polypeptide form through transcription and translation. The preparation of mRNA by transcription is also one form of expression. Thus, in the present specification, "expression product" includes such a polypeptide or a protein, or mRNA. More preferably, such a polypeptide form can be a post-translationally processed form. For example, the expression level of FSTL1 or CTLA4 can be determined by an arbitrary method. Specifically, the expression level of FSTL1 or CTLA4 can be determined by evaluating the amount of FSTL1 or CTLA4 mRNA, the amount of the FSTL1 or CTLA4 protein, and the biological activity of the FSTL1 or CTLA4 protein. Such a measurement value can be used in companion diagnostics. The amount of the FSTL1 or CTLA4 mRNA or protein can be determined by a method described in detail in another section herein or any other method known in the art.

In the present specification, "functional equivalent" refers to an arbitrary form that has an intended function equivalent to that of the original entity of interest, but differs structurally therefrom. Thus, it is understood that a functional equivalent of "FSTL1 or CTLA4", or an antibody thereagainst is not FSTL1 or CTLA4, or the antibody itself, but encompasses a mutant or altered form (e.g., an amino acid sequence altered form) of FSTL1 or CTLA4, or the antibody having biological effects possessed by FSTL1 or CTLA4, and a form that can be converted to FSTL1 or CTLA4, or the antibody itself, or a mutant or altered form of this FSTL1 or CTLA4, or the antibody at the time of acting (including e.g., a nucleic acid encoding FSTL1 or CTLA4, or the antibody itself, or a mutant or altered form of this FSTL1 or CTLA4, or the antibody, and a vector, a cell, and the like comprising the nucleic acid). In the present invention, it is understood that the functional equivalent of FSTL1 or CTLA4, or an antibody thereagainst can be used similarly to FSTL1 or CTLA4, or the antibody even if no mentioned so. The functional equivalent can be found by searching a database or the like. In the present specification, "search" refers to utilization of a certain nucleic acid nucleotide sequence electronically or in a biological or any other method to find another nucleic acid nucleotide sequence having a particular function and/or property. Examples of the electronical search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), and Needleman and Wunsch method (Needleman and Wunsch, J. Mol. Biol. 48: 443-453 (1970)). Examples of the biological search include, but are not limited to, stringent hybridization, macroarrays containing genomic DNA attached to nylon membranes or the like or microarrays containing genomic DNA attached to glass sheets (microarray assay), PCR, and in situ hybridization. In the present specification, the gene used in the present invention is intended to also include a corresponding gene identified by such electronical search or biological search.

An amino acid sequence having the insertion, substitution, or deletion of one or more amino acids, or the addition thereof to one or both of the ends can be used in the functional equivalent of the present invention. In the present specification, "amino acid sequence having the insertion, substitution, or deletion of one or more amino acids, or the addition thereof to one or both of the ends" means that the amino acid sequence has been altered by the substitution, etc. of a plurality of amino acids to an extent that can occur naturally by a well-known technical method such as site-directed mutagenesis, or by natural mutation. The altered amino acid sequence can be a sequence that has undergone the insertion, substitution, or deletion of, for example, 1 to 30, preferably 1 to 20, more preferably 1 to 9, further preferably 1 to 5, particularly preferably 1 or 2 amino acids, or the addition thereof to one or both of the ends. The altered amino acid sequence may be preferably an amino acid sequence derived from the amino acid sequence of FSTL1 or CTLA4 by the conservative substitution of one or more (preferably 1 or several or 1, 2, 3, or 4) amino acids. In this context, "conservative substitution" means that one or more amino acid residues are substituted by other amino acid residues chemically similar thereto so as not to substantially alter the functions of the protein. Examples thereof include the substitution of a certain hydrophobic residue by another hydrophobic residue, and the substitution of a certain polar residue by another polar residue having the same electric charge thereas. Functionally similar amino acids that permit such substitution are known in the art about each amino acid. Specific examples thereof include: non-polar (hydrophobic) amino acids such as alanine, valine, isoleucine, leucine, proline, tryptophan, phenylalanine, and methionine; polar (neutral) amino acids such as glycine, serine, threonine, tyrosine, glutamine, asparagine, and cysteine; positively charged (basic) amino acids such as arginine, histidine, and lysine; and negatively charged (acidic) amino acids such as aspartic acid and glutamic acid.

In the present specification, "suppressor" refers to a substance or an agent that inhibits the biological effects of the entity of interest (e.g., receptor or cells). The FSTL1 or CTLA4 suppressor of the present invention is an agent that can transiently or permanently reduce or delete the functions of the FSTL1 or CTLA4 or FSTL1- or CTLA4-expressing cells, etc. of interest. Examples of such an agent can include, but are not limited to, forms of antibodies, antigen binding fragments thereof, derivatives of the antibodies or the fragments, functional equivalents, antisenses, and nucleic acids such as RNAi agents (e.g., siRNA).

In the present specification, "agonist" refers to a substance that exhibits or enhances the biological effects of the entity of interest (e.g., receptor). Examples thereof can include natural agonists (also called ligands) as well as synthesized or altered agonists.

In the present specification, "antagonist" refers to a substance that suppresses or inhibits the exertion of the biological effects of the entity of interest (e.g., receptor). Examples thereof can include natural antagonists as well as synthesized or altered antagonists. The antagonist includes, for example, a substance that performs competitive suppression or inhibition with an agonist (or ligand) as well as a substance that performs non-competitive suppression or inhibition therewith. The antagonist can be obtained by altering the agonist. Because of suppressing or inhibiting physiological phenomena, the antagonist may be conceptually encompassed by a suppressor (inhibitor) or a suppressive (suppressing) agent. Thus, the antagonist is used herein substantially interchangeably with "suppressor".

In the present specification, "antibody" includes a polyclonal antibody, a monoclonal antibody, a multispecific antibody, a chimeric antibody, and an anti-idiotype antibody, and their fragments, for example, a Fv fragment, a Fab' fragment, F(ab')2, and a Fab fragment, and any other conjugate or functional equivalent produced by recombination (e.g., a chimeric antibody, a humanized antibody, a multifunctional antibody, a bispecific or oligospecific antibody, a single-chain antibody, scFv, diabody, sc(Fv)2 (single chain (Fv)2), and scFv-Fc), in a broad sense. Such an antibody may be further covalently bound with or recombinantly fused with an enzyme, for example, alkaline phosphatase, horseradish peroxidase, or a galactosidase. The anti-FSTL1 antibody or the anti-CTLA4 antibody used in the present invention is not limited by its origin, type, shape, etc. as long as the antibody binds to the FSTL1 or CTLA4 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 or CTLA4 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "anti-FSTL1 antibody or anti-CTLA4 antibody" includes an antibody having binding activity against FSTL1 or CTLA4. A method for producing this anti-FSTL1 antibody or anti-CTLA4 antibody is not particularly limited, and the antibody may be produced, for example, by immunizing a mammal or bird with FSTL1 or CTLA4.

It is also understood that "functional equivalent" of "antibody against FSTL1 or CTLA4 (anti-FSTL1 antibody or anti-CTLA4 antibody) or fragment thereof" also encompasses, for example, in the case of an antibody, the antibody itself and its fragment itself having binding activity and, if necessary, suppressive activity against FSTL1 or CTLA4 as well as a chimeric antibody, a humanized antibody, a multifunctional antibody, a bispecific or oligospecific antibody, a single-chain antibody, scFv, diabody, sc(Fv)$_2$ (single chain (Fv)$_2$), scFv-Fc, and the like.

The anti-FSTL1 antibody or the anti-CTLA4 antibody according to one embodiment of the present invention is preferably an anti-FSTL1 antibody or an anti-CTLA4 antibody specifically binding to a particular epitope on FSTL1 or CTLA4, from the viewpoint that the growth of malignant tumor is particularly strongly suppressed.

The anti-FSTL1 antibody or the anti-CTLA4 antibody according to one embodiment of the present invention may be a monoclonal antibody. The monoclonal antibody can be allowed to act on FSTL1 or CTLA4 more efficiently than a polyclonal antibody. It is preferred to immunize a chicken with FSTL1 or CTLA4, from the viewpoint of efficiently producing the anti-FSTL1 or CTLA4 monoclonal antibody.

The antibody class of the anti-FSTL1 antibody or the anti-CTLA4 antibody according to one embodiment of the present invention is not particularly limited and may be, for example, IgM, IgD, IgG, IgA, IgE, or IgY.

The anti-FSTL1 antibody or the anti-CTLA4 antibody according to one embodiment of the present invention may be an antibody fragment having antigen binding activity (hereinafter, also referred to as "antigen binding fragment"). This case is effective, for example, for elevating stability or antibody production efficiency.

The anti-FSTL1 antibody or the anti-CTLA4 antibody according to one embodiment of the present invention may be a fusion protein. This fusion protein may be the anti-FSTL1 antibody or the anti-CTLA4 antibody N- or C-terminally bound with a polypeptide or an oligopeptide. In this context, the oligopeptide may be a His tag. The fusion protein may also be the anti-FSTL1 antibody or the anti-CTLA4 antibody fused with a partial sequence of a mouse, human, or chicken antibody. Such fusion proteins are also included in one form of the anti-FSTL1 antibody or the anti-CTLA4 antibody according to the present embodiment.

The anti-FSTL1 antibody or the anti-CTLA4 antibody according to one embodiment of the present invention may be an antibody obtained through, for example, the step of immunizing an organism with purified FSTL1 or CTLA4, FSTL1- or CTLA4-expressing cells, or a FSTL1- or CTLA4-containing lipid membrane. It is preferred to use FSTL1- or CTLA4-expressing cells in the immunization, from the viewpoint of enhancing therapeutic effects on FSTL1- or CTLA4-positive malignant tumor.

The anti-FSTL1 antibody or the anti-CTLA4 antibody according to one embodiment of the present invention may be an antibody having the CDR set of the antibody obtained through the step of immunizing an organism with purified FSTL1 or CTLA4, FSTL1- or CTLA4-expressing cells, or a FSTL1- or CTLA4-containing lipid membrane. It is preferred to use FSTL1- or CTLA4-expressing cells in the immunization, from the viewpoint of enhancing therapeutic effects on FSTL1- or CTLA4-positive malignant tumor. The CDR set is a set of heavy chain CDR1, CDR2, and CDR3 and light chain CDR1, CDR2, and CDR3.

In one embodiment of the present invention, "FSTL1- or CTLA4-expressing cells" may be obtained, for example, by transfecting cells with a polynucleotide encoding FSTL1 or CTLA4, followed by the expression of FSTL1 or CTLA4. In this context, the FSTL1 or the CTLA4 includes a FSTL1 or CTLA4 fragment. In one embodiment of the present invention, "FSTL1- or CTLA4-containing lipid membrane" may be obtained, for example, by mixing FSTL1 or CTLA4 with a lipid bilayer. In this context, the FSTL1 or the CTLA4 includes a FSTL1 or CTLA4 fragment. The anti-FSTL1 antibody or the anti-CTLA4 antibody according to one embodiment of the present invention is preferably an antibody obtained through the step of immunizing a chicken with the antigen, or an antibody having the CDR set of the antibody, from the viewpoint of enhancing therapeutic effects on FSTL1- or CTLA4-positive malignant tumor.

The anti-FSTL1 antibody or the anti-CTLA4 antibody according to one embodiment of the present invention may have any avidity as long as the purpose is attained. Examples thereof can include, but are not limited to, at least $1.0 \times 10^6$ or more, $2.0 \times 10^6$ or more, $5.0 \times 10^6$ or more, and $1.0 \times 10^7$ or more avidity. Usually, the KD value (kd/ka) may be $1.0 \times 10^{-7}$ or less and can be $1.0 \times 10^{-9}$ (M) or $1.0 \times 10^{-10}$ (M) or less.

The anti-FSTL1 antibody or the anti-CTLA4 antibody according to one embodiment of the present invention may have ADCC or CDC activity.

The anti-FSTL1 antibody or the anti-CTLA4 antibody according to one embodiment of the present invention may be an antibody binding to wild-type or mutant-type FSTL1 or CTLA4. The mutant type includes a form attributed to the difference in DNA sequence among individuals. The amino acid sequence of the wild-type or mutant-type FSTL1 or CTLA4 has preferably 80% or higher, more preferably 90% or higher, more preferably 95% or higher, particularly preferably 98% or higher homology to the amino acid sequence represented by SEQ ID NO: 504 or SEQ ID NO: 506.

In one embodiment of the present invention, "antibody" includes a molecule that can specifically bind to a particular epitope on an antigen, or a population thereof. Also, the antibody may be a polyclonal antibody or a monoclonal antibody. The antibody can be present in various forms and may be in one or more forms selected from the group consisting of, for example, a full-length antibody (antibody having Fab and Fc regions), a Fv antibody, a Fab antibody, a F(ab')$_2$ antibody, a Fab' antibody, diabody, a single-chain antibody (e.g., scFv, dsFv, a multispecific antibody (e.g., a bispecific antibody), a peptide or polypeptide having antigen binding activity, a chimeric antibody (e.g., a mouse-human chimeric antibody and a chicken-human chimeric antibody), a mouse antibody, a chicken antibody, a humanized antibody, a human antibody, and their equivalents. The antibody also includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach. Such an antibody may be further covalently bound with or recombinantly fused with an enzyme, for example, alkaline phosphatase, horseradish peroxidase, or a galactosidase. The anti-FSTL1 antibody or the anti-CTLA4 antibody used in the present invention is not limited by its origin, type, shape, etc. as long as the antibody binds to the FSTL1 or CTLA4 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 or CTLA4 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "polyclonal antibody" can be produced, for example, by administering an immunogen comprising the intended antigen to a mammal (e.g., a rat, a mouse, a rabbit, cattle, and a monkey), bird, or the like in order to induce the production of an antigen-specific polyclonal antibody. The administration of the immunogen may be the injection of one or more immunizing agents and, if desired, an adjuvant. The adjuvant may also be used for increasing immune response and may include, for example, a Freund's adjuvant (complete or incomplete), a mineral gel (aluminum hydroxide, etc.), or a surfactant (lysolecithin, etc.). An immunization protocol is known in the art and may be carried out by an arbitrary method for inducing immune response according to a host organism to be selected (Tanpakushitsu Jikken Handobukku (Protein Experiment Handbook in English), Yodosha Co., Ltd. (2003): 86-91).

In one embodiment of the present invention, "monoclonal antibody" includes the case where individual antibodies constituting a population are antibodies each corresponding to a substantially single epitope except for antibodies having a small amount of a mutation that can occur naturally. Alternatively, the individual antibodies constituting a population may be substantially identical antibodies except for antibodies having a small amount of a mutation that can occur naturally. The monoclonal antibody is highly specific and differs from an ordinary polyclonal antibody which typically comprise different antibodies corresponding to different epitopes. In addition to the specificity, the monoclonal antibody is useful because the monoclonal antibody can be synthesized from hybridoma culture that is not contaminated with other immunoglobulins. The epithet "monoclonal" may indicate the feature of being obtained from a substantially homogeneous antibody population, but does not mean that the antibody must be produced by a certain method. For example, the monoclonal antibody may be prepared by a method similar to a hybridoma method as described in "Kohler G, Milstein C., Nature. 1975 Aug. 7; 256 (5517): 495-497". Alternatively, the monoclonal antibody may be prepared by a method similar to a recombination method as described in U.S. Pat. No. 4,816,567. Alternatively, the monoclonal antibody may be isolated from a phage antibody library by use of a method similar to a technique as described in "Clackson et al., Nature. 1991 Aug. 15; 352 (6336): 624-628" or "Marks et al., J Mol Biol. 1991 Dec. 5; 222 (3): 581-597". Alternatively, the monoclonal antibody may be prepared by a method described in "Tanpakushitsu Jikken Handobukku (Protein Experiment Handbook in English), Yodosha Co., Ltd. (2003): 92-96".

For the large-scale production of the antibody, an arbitrary approach known in the art can be used. Typical examples of the construction of a large-scale antibody production system and antibody production can include the following: CHO cells are transfected with a H chain antibody expression vector and a L chain antibody expression vector, cultured using a selection reagent G418 and Zeocin, and cloned by a limiting dilution method. After the cloning, a clone stably expressing the antibody is selected by ELISA. The selected CHO cell is used in extended culture to recover a culture supernatant containing the antibody. The antibody can be purified by protein A or protein G purification from the recovered culture supernatant.

In one embodiment of the present invention, "Fv antibody" is an antibody containing an antigen recognition site. This region comprises a dimer of one heavy chain variable domain and one light chain variable domain through non-covalent binding. In this configuration, the respective three CDRs of the variable domains can act mutually to form an antigen binding site on the surface of the VH-VL dimer.

In one embodiment of the present invention, "Fab antibody" is, for example, an antibody comprising the N-terminal half of the H chain and the whole L chain disulfide-bonded at a part of the antibody, among fragments obtained by treating an antibody comprising Fab and Fc regions with a proteolytic enzyme papain. Fab can be obtained, for example, by treating the anti-FSTL1 antibody or the anti- CTLA4 antibody according to the embodiments of the present invention comprising Fab and Fc regions with a proteolytic enzyme papain.

In one embodiment of the present invention, "F(ab')$_2$ antibody" is, for example, an antibody containing two sites each corresponding to Fab, among fragments obtained by treating an antibody comprising Fab and Fc regions with a proteolytic enzyme pepsin. F(ab')$_2$ can be obtained, for example, by treating the anti-FSTL1 antibody or the anti-CTLA4 antibody according to the embodiments of the present invention comprising Fab and Fc regions with a proteolytic enzyme pepsin. Also, F(ab')$_2$ can be prepared, for example, by thioether-bonding or disulfide-bonding Fab' fragments described below.

In one embodiment of the present invention, "Fab' antibody" is, for example, an antibody obtained by cleaving the disulfide bond in the hinge region of F(ab')$_2$. Fab' can be obtained, for example, by treating F(ab')$_2$ with a reducing agent dithiothreitol.

In one embodiment of the present invention, "scFv antibody" is an antibody comprising VH and VL linked via an appropriate peptide linker. The scFv antibody can be produced, for example, by obtaining cDNAs encoding VH and VL of the anti-FSTL1 antibody or the anti-CTLA4 antibody according to the embodiments of the present invention, constructing a polynucleotide encoding VH-peptide linker-VL, and integrating the polynucleotide into a vector, followed by use of cells for expression.

In one embodiment of the present invention, "diabody" is an antibody having divalent antigen binding activity. The divalent antigen binding activity may be the same antigen binding activities or may be different antigen binding activities. The diabody can be produced, for example, by constructing polynucleotides encoding scFvs such that the length of the amino acid sequence of a peptide linker is 8 or less residues, and integrating the obtained polynucleotides into a vector, followed by use of cells for expression.

In one embodiment of the present invention, "dsFv" is an antibody obtained by bonding polypeptides containing cysteine residues introduced in VH and VL, via a disulfide bond between the cysteine residues. The positions to which the cysteine residues are introduced can be selected on the basis of the conformational prediction of the antibody according to a method shown by Reiter et al. (Reiter et al., Protein Eng. 1994 May; 7 (5): 697-704).

In one embodiment of the present invention, "peptide or polypeptide having antigen binding activity" is an antibody constituted to comprise the VH or VL of the antibody, or CDR1, CDR2, or CDR3 thereof. A plurality of CDR-containing peptides can be bonded directly or via an appropriate peptide linker.

A method for producing the Fv antibody, Fab antibody, F(ab')$_2$ antibody, Fab' antibody, scFv antibody, diabody, dsFv antibody, or peptide or polypeptide having antigen binding activity (hereinafter, also referred to as "Fv antibody, etc.") described above is not particularly limited. For example, DNA encoding a region in the Fv antibody, etc. for the anti-FSTL1 antibody or the anti-CTLA4 antibody according to the embodiments of the present invention is integrated into a vector for expression, and the Fv antibody, etc. can be produced using cells for expression. Alternatively, the Fv antibody, etc. may be produced by a chemical synthesis method such as Fmoc method (fluorenylmethyloxycarbonyl method) or tBOC method (t-butyloxycarbonyl method). The antigen binding fragment according to one embodiment of the present invention may be one or more of the Fv antibody, etc.

In one embodiment of the present invention, "chimeric antibody" is, for example, an antibody comprising the variable regions of an antibody of an organism species linked to the constant regions of an antibody of an organism species different therefrom, and can be constructed by a gene recombination technique. A mouse-human chimeric antibody can be prepared by a method described in, for example, "Roguska et al., Proc Natl Acad Sci USA. 1994 Feb. 1; 91 (3): 969-973". In a basic method for preparing the mouse-human chimeric antibody, for example, mouse leader sequences and variable region sequences present in cloned cDNA are linked to human antibody constant region-encoding sequences already present in an expression vector for mammalian cells. Alternatively, mouse leader sequences and variable region sequences present in cloned cDNA may be linked to human antibody constant region-encoding sequences and then ligated with an expression vector for mammalian cells. Fragments of human antibody constant regions can be arbitrary H and L chain constant regions of a human antibody. Examples thereof can include Cyl, Cy2, Cy3, and Cy4 for human H chains and or CK for L chains.

In one embodiment of the present invention, "humanized antibody" is, for example, an antibody that has one or more CDRs derived from a non-human species and framework regions (FRs) derived from a human immunoglobulin, and further, human immunoglobulin-derived constant regions, and binds to a desired antigen. The antibody humanization can be carried out by use of various approaches known in the art (Almagro et al., Front Biosci. 2008 Jan. 1; 13: 1619-1633). Examples thereof include CDR grafting (Ozaki et al., Blood. 1999 Jun. 1; 93 (11): 3922-3930), re-surfacing (Roguska et al., Proc Natl Acad Sci USA. 1994 Feb. 1; 91 (3): 969-973), and FR shuffle (Damschroder et al., Mol Immunol. 2007 April; 44 (11): 3049-3060. Epub 2007 Jan. 22). In order to alter (preferably, improve) antigen binding, an amino acid residue in a human FR region may be substituted by a corresponding residue from a CDR donor antibody. This FR substitution can be carried out by a method well known in the art (Riechmann et al., Nature. 1988 Mar. 24; 332 (6162): 323-327). For example, a FR residue important for antigen binding may be identified by the interaction modeling of CDR and FR residues. Alternatively, an abnormal FR residue may be identified at a particular position by sequence comparison. In a preferred embodiment, the humanized antibody may be produced on the basis of the report of Matsuda et al. Molecular Immunology 43 (2006) 634-642.

In a preferred embodiment of the present invention, a humanized antibody having the H chain FR1, FR2, FR3, and FR4 (SEQ ID NOs: 671, 673, 675, and 677, respectively) and L chain FR1, FR2, FR3, and FR4 (SEQ ID NOs: 687, 689, 691, and 693, respectively) of H(2)-L(1) can be used, though the humanized antibody of the present invention is not limited thereto. As for the full-length sequences of the humanized antibody, the full-length sequence of the H(1) heavy chain in this humanized antibody is represented by SEQ ID NOs: 694 and 695 (which represent nucleic acid and amino acid sequences, respectively) for IgG1 type and represented by SEQ ID NOs: 700 and 701 (which represent nucleic acid and amino acid sequences, respectively) for IgG4 type. The full-length sequence of the H(2) heavy chain is represented by SEQ ID NOs: 696 and 697 (which represent nucleic acid and amino acid sequences, respectively) for IgG1 type and represented by SEQ ID NOs: 702 and 703 (which represent nucleic acid and amino acid sequences, respectively) for IgG4 type. The full-length sequence of the H(3) heavy chain is represented by SEQ ID NOs: 698 and 699 (which represent nucleic acid and amino acid sequences, respectively) for IgG1 type and represented by SEQ ID NOs: 704 and 705 (which represent nucleic acid and amino acid sequences, respectively) for IgG4 type. The full-length sequence of the L(1) light chain is represented by SEQ ID NOs: 706 and 707 (which represent nucleic acid and amino acid sequences, respectively). The full-length sequence of the L(2) light chain is represented by SEQ ID NOs: 748 and 749 (which represent nucleic acid and amino acid sequences, respectively). The full-length sequence of the L(3) light chain is represented by SEQ ID NOs: 750 and 751 (which represent nucleic acid and amino acid sequences, respectively). Although not wishing to be bound by any theory, activity higher by an order of magnitude was observed in H(2)-L(1) than H(3)-L(1) (frameworks of H(3): SEQ ID NOs: 679, 681, 683, and 685, respectively) and H(1)-L(1) (frameworks of H(1): SEQ ID NOs: 663, 665, 667, and 669, respectively).

In one embodiment of the present invention, "human antibody" is, for example, an antibody in which a region comprising heavy chain variable and constant regions and light chain variable and constant regions constituting the antibody is derived from a gene encoding a human immunoglobulin. A typical preparation method includes a transgenic mouse method for human antibody preparation, a phage display method, or the like. In the transgenic mouse method for human antibody preparation, a human antibody having diverse antigen binding ability instead of a mouse antibody is produced by transferring a functional human Ig gene to a mouse in which endogenous Ig has been knocked down. A human monoclonal antibody can be obtained by a conventional hybridoma method by further immunizing this mouse. This preparation can be performed by a method described in, for example, "Lonberg et al., Int Rev Immunol. 1995; 13 (1): 65-93". The phage display method is typically a system that allows a fibrous phage such as M13 or T7, an *E. coli* virus, to express a foreign gene as a fusion protein at the N terminus of its coat protein (g3p, g10p, etc.) so as not to lose the infectivity of the phage. This preparation can be performed by a method described in, for example, "Vaughan et al., Nat Biotechnol. 1996 March; 14 (3): 309-314".

The antibody may be prepared by grafting the heavy chain CDRs or light chain CDRs of the anti-FSTL1 antibody or the anti-CTLA4 antibody according to the embodiments of the present invention to an arbitrary antibody according to CDR grafting (Ozaki et al., Blood. 1999 Jun. 1; 93 (11): 3922-3930). Alternatively, the antibody can be obtained by ligating DNAs encoding the heavy chain CDRs or light chain CDRs of the anti-FSTL1 antibody or the anti-CTLA4 antibody according to the embodiments of the present invention, and DNAs encoding the regions, except for heavy chain CDRs or light chain CDRs, of a publicly known antibody derived from a human or a non-human organism with a vector according to a method known in the art, followed by expression using publicly known cells. In this respect, in order to enhance the action efficiency of the anti-FSTL1 antibody or the anti-CTLA4 antibody on the target antigen, the regions except for heavy chain CDRs or light chain CDRs may be optimized by use of a method known in the art (e.g., a method of randomly mutating amino acid residues of antibodies and screening for an antibody having high reactivity, or a phage display method). Also, FR regions may be optimized by use of, for example, FR shuffle (Damschroder et al., Mol Immunol. 2007 April; 44 (11): 3049-3060, Epub 2007 Jan. 22) or a method for substituting vernier zone amino acid residues or packaging residues (Japanese Patent Laid-Open No. 2006-241026; and Foote et al., J Mol Biol. 1992 Mar. 20; 224 (2): 487-499).

In one embodiment of the present invention, "heavy chain" is typically a main constituent of a full-length antibody. The heavy chain is usually disulfide-bonded or non-covalently bonded to a light chain. The N-terminal domain of the heavy chain has a region called variable region (VH) whose amino acid sequence is not constant even among antibodies of the same species and the same class. In general, VH is known to largely contribute to specificity and affinity for an antigen. For example, "Reiter et al., J Mol Biol. 1999 Jul. 16; 290 (3): 685-98" states that a molecule of only VH was prepared and consequently bound to an antigen specifically and with high affinity. "Wolfson W, Chem Biol. 2006 December; 13 (12): 1243-1244" states that among camel antibodies, there exist antibodies lacking light chains and having only heavy chains.

In one embodiment of the present invention, "CDRs (complementarity determining regions)" are regions that come in actual contact with an antigen and form a binding site in the antibody. In general, CDRs are positioned on Fv (comprising a heavy chain variable region variable region (VH) and a light chain variable region (VL)) of the antibody. In general, CDRs include CDR1, CDR2, and CDR3 each consisting of approximately 5 to 30 amino acid residues. Particularly, heavy chain CDRs are known to contribute to the binding of the antibody to the antigen. Among CDRs, CDR3 is known to make the highest contribution to the binding of the antibody to the antigen. For example, "Willy et al., Biochemical and Biophysical Research Communications Volume 356, Issue 1, 27 Apr. 2007, Pages 124-128" states that the binding ability of an antibody was enhanced by altering heavy chain CDR3. Fv regions other than CDRs are called framework regions (FRs) which consist of FR1, FR2, FR3, and FR4, and are relatively well conserved among antibodies (Kabat et al., "Sequence of Proteins of Immunological Interest", US Dept. Health and Human Services, 1983). In short, a factor that characterizes the reactivity of the antibody is CDRs, particularly, heavy chain CDR.

There are a plurality of reports on the definition of CDRs and methods for determining the positions thereof. For example, the definition of Kabat (Sequences of Proteins of Immunological Interest, 5th ed., Public Health Service, National Institutes of Health, Bethesda, Md. (1991)) or the definition of Chothia (Chothia et al., J. Mol. Biol., 1987; 196: 901-917) may be adopted. In one embodiment of the present invention, the definition of Kabat is adopted as a suitable example, though the definition of CDRs is not necessarily limited thereto. In some cases, CDRs may be determined in consideration of both the definition of Kabat and the definition of Chothia. For example, overlapping moieties of CDRs according to the respective definitions or moieties including both CDRs of the respective definitions may be used as CDRs. Specific examples of such a method include the method of Martin et al. using Oxford Molecular's AbM antibody modeling software (Proc. Natl. Acad. Sci. USA, 1989; 86: 9268-9272), which is a combined method of the definition of Kabat and the definition of Chothia. A mutant that may be used in the present invention can be produced using such information on CDRs. Such an antibody mutant can be produced such that the substitution, addition, or deletion of 1 or several (e.g., 2, 3, 4, 5, 6, 7, 8, 9, and 10) amino acids is contained in a framework of the original antibody whereas no mutation is contained in the CDRs.

In the present specification, "antigen" refers to an arbitrary substrate to which an antibody molecule is capable of specifically binding. In the present specification, "immunogen" refers to an antigen capable of initiating lymphocyte activation resulting in antigen-specific immune response. In the present specification, "epitope" or "antigen determinant" refers to a site in an antigen molecule to which an antibody or a lymphocyte receptor binds. A method for determining the epitope is well known in the art. Those skilled in the art can determine such an epitope by use of such a well-known technique conventionally used, provided that the primary sequence of a nucleic acid or an amino acid is provided. It is understood that an antibody having a sequence different from that of the antibody of the present invention can be similarly used as long as the epitope for the antibody is the same as that for the antibody of the present invention.

It is understood that an antibody having any specificity may be used as the antibody used herein as long as false positivity is decreased. Thus, the antibody used in the present invention may be a polyclonal antibody or may be a monoclonal antibody.

In the present specification, "means" refers to a unit that can serve as an arbitrary tool to achieve a certain purpose (e.g., detection, diagnosis, and treatment). In the present specification, particularly, "selectively recognizing means" refers to means that can recognize a certain subject distinctively from others.

"Malignant tumor" used herein includes, for example, tumor that is developed by the mutation of normal cells. The malignant tumor may be developed from every organ or tissue throughout the body. The malignant tumor is used herein interchangeably with "cancer" unless otherwise specified. This malignant tumor includes one or more selected from the group consisting of, for example, lung cancer, esophageal cancer, stomach cancer, liver cancer, pancreatic cancer, kidney cancer, adrenal cancer, bile duct cancer, breast cancer, colorectal cancer, small intestine cancer, ovary cancer, uterine cancer, bladder cancer, prostate cancer, ureter cancer, renal pelvis cancer, ureter cancer, penis cancer, testis cancer, brain tumor, cancer of the central nervous system, cancer of the peripheral nervous system, head and neck cancer, glioma, glioblastoma multiforme, skin cancer, melanoma, thyroid gland cancer, salivary gland cancer, malignant lymphoma, carcinoma, sarcoma, leukemia, and malignant blood tumor. In this context, the ovary cancer includes, for example, ovarian serous adenocarcinoma or ovarian clear cell adenocarcinoma. The uterine cancer includes, for example, endometrial cancer or uterine cervical cancer. The head and neck cancer includes, for example, mouth cancer, throat cancer, larynx cancer, nasal cavity cancer, sinus cancer, salivary gland cancer, or thyroid gland cancer. The lung cancer includes, for example, non-small cell lung cancer or small-cell lung cancer. The malignant tumor may be FSTL1- or CTLA4-positive.

In the present specification, "metastasis" refers to the process in which cancer spreads or travels from a primary focus to other regions of the body to develop a similar cancerous lesion at a new site. "Metastatic" or "metastasizing" cell is a cell that loses adhesive contact with adjacent cells and travels from a primary focus of the disease through blood flow or lymph to invade a neighboring structure of the body. In the present specification, the term "metastasis" preferably includes, but is not limited to, metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the metastasis of the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, "bone metastasis" means metastasis of cancer to bone and includes bone metastasis of an arbitrary origin. The term "bone metastasis" preferably includes, but is not limited to, bone metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the term "bone metastasis" also preferably includes a bone lesion, preferably an osteolytic and/or osteogenic bone lesion, more preferably an osteolytic bone lesion, still more preferably a bone lesion of myeloma, malignant myeloma, and/or multiple myeloma, particularly an osteolytic bone lesion of myeloma, malignant myeloma, and/or multiple myeloma. According to the present invention, the term "bone metastasis" also preferably includes a bone lesion of Waldenstrom's disease, preferably an osteolytic and/or osteogenic bone lesion of Waldenstrom's disease, more preferably an osteolytic bone lesion of Waldenstrom's disease. The bone metastasis according to the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

Mesenchymal stem cells induce or enhance immune defect such as immunosuppression or immunodeficiency. Activation is essential for acquiring this activity. MSCs increasing in number in association with cancer are considered to be "activated MSCs" after activation by various in vivo agents. In the present specification, such MSCs are also referred to as "activated mesenchymal stem cells" or "activated MSCs". Specifically, there exists the mechanism of immune defect, including, for example, the case where cells originally having immunosuppressive activity (e.g., regulatory T cells, tolerogenic dendritic cells, regulatory dendritic cells, and myeloid-derived suppressor cells) grow so that immunosuppressive activity is comprehensively strengthened, the case where cells normally having no activity (i.e., progenitor cells) acquire immunosuppressive properties to increase the rate of conversion to their cells having immunosuppressive activity (e.g., regulatory T cells, tolerogenic dendritic cells, regulatory dendritic cells, and myeloid-derived suppressor cells) so that immunosuppressive activity is strengthened, and induction of exhausted T cells that fall into an immunocompromised status that fails to exert immune functions. FSTL1 is considered to control the mechanism directly and/or indirectly via the growth of activated MSCs, etc. (Immunology and Cell Biology 91: 12-18, 2013). Although not wishing to be bound by any theory, the antibody FSTL1 antibody, etc. of the present invention can inhibit the induction or enhancement of immunosuppression by these MSCs, and immunodeficiency, etc. and can thereby mitigate immunosuppression responsible for the aggravation of cancer. Hence, remarkable prophylactic or therapeutic effects on cancer can be achieved. As for the induction or enhancement of MSCs inducing these cells for immune defect such as immunosuppressive cells and/or immunodeficient cells, it is considered that the present invention can inhibit an upstream region thereof and can therefore mitigate the whole mechanism of immune defect such as immunosuppression and/or immunodeficiency. Thus, more effective treatment is probably achieved.

The suppression of induction or growth of mesenchymal stem cells (MSCs) (including cancer-associated MSCs and activated MSCs) can be confirmed, for example, by examining the inhibition of differentiation of MSCs into adipocytes, for example, as shown in FIGS. 71 and 72. Although not wishing to be bound by any theory, FSTL1 is considered to increase the number of immunosuppressive MSCs themselves and/or to strengthen suppressive activity against other cells.

In the present specification, "enhancement" of "immunosuppression" (the term "immunosuppression" is also referred to as immunosuppressive properties, immunoregulation, immunoregulatory properties, immunomodulation, immunomodulatory properties, immunomodification, and immunomodifying properties, and these terms are used interchangeably in the art) conceptually encompasses enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells) and refers to consequent enhancement of immunosuppression. Thus, it is understood that the enhancement of immunosuppression conceptually includes enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells). The manner of induction of immunosuppressive cells by MSC cells encompasses promotion of differentiation into immunosuppressive cells such as regulatory T cells, enhancement of the immunosuppressive activity of immunosuppressive cells such as regulatory T cells, and growth of immunosuppressive cells such as regulatory T cells, and encompasses consequent enhancement of immunosuppressive properties.

In the present specification, "immunosuppressive cells" (the term "immunosuppressive" is also referred to as immunoregulatory, immunomodulatory, and immunomodifying, and these terms are used interchangeably in the art) refer to cells having a function of suppressing immune competence. Typical examples thereof can include, but are not limited to, regulatory T cells, regulatory dendritic cells, tolerogenic dendritic cells, and myeloid-derived suppressor cells.

It is known that not only immunosuppression as described above but immunodeficiency plays a role in the mechanism underlying the disruption of immune functions by mesenchymal stem cells (MSCs). The immunosuppression and the immunodeficiency are collectively referred to as "immune defect".

In the present specification, "immunodeficiency" refers to a state in which the normal immune mechanism has been damaged due to a lack or dysfunction of a portion or some of cellular elements constituting the immune system. Pathological conditions caused thereby are collectively referred to as immunodeficiency diseases. The immunodeficiency diseases are broadly divided into primary and secondary diseases. The former is mainly ascribable to congenital genetic abnormality, and the latter refers to diseases caused by physicochemical factors such as drugs or X-ray or external environmental factors such as viral infection or nutritional status. The damaged site is reportedly attributed to various causes such as dysfunction of a B cell zone such as antibody production, abnormality in T cell zone involved in cellular immunity, and impaired functions of cells of the complement system or the phagocytic system (e.g., a phagocytic function). "Exhausted T cells" serve as a main index for immunodeficiency. The anti-PD-1 antibody, etc. is also developed as an antibody that can inhibit this "exhaustion/incompetence".

In the present specification, "immune defect" conceptually refers to immunosuppression and immunodeficiency in combination. When the immune defect occurs, low immunogenic cancer cells more advantageous for survival grow selectively (an equilibrium phase (state in which cancer cells neither disappear nor grow through their interaction with immunocytes) is shifted to an escape phase). It is considered that the immunogenicity of cancer is reduced in a short time from the end of the equilibrium phase through the escape phase. T cells supposed to kill cancer cells reportedly play this role paradoxically.

In the present specification, "exhaustion" means that various co-suppressive molecules such as PD-1, CTLA4, and TIM3 (mentioned later) are induced on T cells due to long-term exposure to an antigen so that the T cells fall into a dysfunctional state. This is considered to be responsible for inducing the irresponsiveness of T cells in chronic infection or cancer. In the present specification, such T cells are referred to as "exhausted T cells".

The anti-PD-1 antibody, etc. is also developed as an antibody that can inhibit this "exhausted" state and "immunodeficiency". Thus, the anti-FSTL1 antibody used in the present invention can inhibit (growth or development of) exhausted T cells as shown in Examples, and is therefore expected to be able to inhibit such "exhausted" state and "immunodeficiency". Thus, it is understood that "immune defect" can be inhibited.

In the present specification, "immune-related cells" refer to arbitrary cells of the immune system that undergo immunosuppression, dysfunction, etc. In the present specification, it is understood that "acquirement and/or enhancement of immunosuppressive activity by or of immune-related cells" typically include, for example, growth of regulatory T cells, differentiation into regulatory T cells, growth of regulatory dendritic cells, differentiation into regulatory dendritic cells, growth of tolerogenic dendritic cells, differentiation into tolerogenic dendritic cells, growth of myeloid-derived suppressor cells, differentiation into myeloid-derived suppressor cells, and expansion of exhausted T cells.

In the present specification, "test subject" refers to a subject to be diagnosed, detected, or treated, for example, according to the present invention (e.g., an organism such as a human, or cells, blood, serum, etc. separated from the organism).

In the present specification, "sample" refers to an arbitrary substance obtained from a test subject or the like and includes, for example, serum. Those skilled in the art can appropriately select a preferred sample on the basis of the description of the present specification.

In the present specification, "agent" is used in a broad sense and may be any substance or other factor (e.g., energy such as light, radioactivity, heat, or electricity) as long as the intended purpose can be attained. Examples of such a substance include, but are not limited to, proteins, polypeptides, oligopeptides, peptides, polynucleotides, oligonucleotides, nucleotides, nucleic acids (including e.g., DNA such as cDNA and genomic DNA, and RNA such as mRNA), polysaccharides, oligosaccharides, lipids, organic small molecules (e.g., hormones, ligands, signaling substances, organic small molecules, molecules synthesized by combinatorial chemistry, and pharmaceutically available small molecules (e.g., low-molecular ligands)), and complex molecules thereof. Typical examples of the agent specific for a polynucleotide include, but are not limited to, a polynucleotide having complementarity with given sequence homology (e.g., 70% or higher sequence identity) to the sequence of the polynucleotide, and a polypeptide such as a transcriptional factor binding to a promoter region. Typical examples of the agent specific for a polypeptide include, but are not limited to, an antibody specifically directed to the polypeptide, or a derivative thereof, or an analog thereof (e.g., a single-chain antibody), a specific ligand or receptor when the polypeptide is a receptor or a ligand, and a substrate when the polypeptide is an enzyme.

In the present specification, "diagnosis" means that various parameters associated with a disease, a disorder, a condition (e.g., malignant tumor), or the like in a test subject are identified to determine the current status or future of such a disease, disorder, or condition. The state within the body can be examined by use of the method, the apparatus, or the system of the present invention. Various parameters such as the disease, disorder, or condition in the test subject, a procedure to be administered, or a formulation or a method for prevention can be selected using such information. In the present specification, "diagnosis" refers to the diagnosis of the current status in a narrow sense and includes "early diagnosis", "predictive diagnostics", "pre-diagnosis", and the like in a broad sense. The diagnosis method of the present invention is industrially useful because the method can utilize materials separated from the body, as a rule, and can be carried out with no help from healthcare professionals such as physicians. In the present specification, particularly, "predictive diagnostics, pre-diagnosis, or diagnosis" is also referred to as "support" in order to clarify feasibility with no help from healthcare professionals such as physicians.

In the present specification, the term "prognosis" means prediction of the possibility of death or progression attributed to cancer, such as recurrence, metastatic spread, and drug resistance of a neoplastic disease such as malignant tumor (e.g., ovary cancer). Thus, in the present specification, "good prognosis" means that recurrent cancer originating from the primary cancer is absent beyond a given period (e.g., 4 years) after cancer tissue resection. "Poor prognosis" means that recurrent cancer originating from the primary cancer is present beyond a given period (e.g., 4 years) after cancer tissue resection. A prognosis factor is a variable regarding the natural course of malignant tumor and influences the rate of recurrence and outcome of a patient that has suffered from malignant tumor. A clinical index related to the worsening of prognosis includes, for example, lymph node metastasis and high-grade tumor. The prognosis factor is often used for classifying patients into subgroups having different basic risks of recurrence. Accordingly, the expression of the FSTL1 of the present invention can be used as a prognosis factor. In the present specification, the term "prediction" means the possibility that a patient has a particular clinical outcome, regardless of whether to be good or poor, after removal of primary tumor. Thus, the FSTL1 of the present invention can be used as a marker for poor prognosis. A treatment method can be determined by selecting a treatment method optimal for a particular patient by clinical use of the prediction method of the present invention. The prediction method of the present invention is beneficial means for prediction provided that there is the possibility that a patient has good response to a treatment regimen, for example, surgical intervention. The prediction can involve a prognosis factor.

In the present specification, "detecting drug (agent)" or "testing drug (agent)" refers to every agent that permits detection or test of a targeted subject in a broad sense.

In the present specification, "diagnostic drug (agent)" refers to every agent that permits diagnosis of a targeted condition (e.g., a disease such as malignant tumor) in a broad sense.

In the present specification, "treatment" of a certain disease or disorder (e.g., malignant tumor) refers to the prevention of aggravation of such a disease or disorder, preferably status quo, more preferably alleviation, further preferably resolution, of such a disease or disorder, after occurrence of such a condition. The treatment includes capability of exerting a symptom-ameliorating effects or prophylactic effects on a disease in a patient or one or more symptoms associated with the disease. Appropriate treatment based on pre-diagnosis is referred to as "companion treatment". A diagnostic drug therefor is also referred to as "companion diagnostic drug".

In the present specification, "therapeutic drug (agent)" refers to every agent that permits treatment of a targeted condition (e.g., a disease such as malignant tumor) in a broad sense. In one embodiment of the present invention, "therapeutic drug" may be a pharmaceutical composition comprising an active ingredient and one or more pharmacologically acceptable carriers. The pharmaceutical composition can be produced, for example, by mixing the active ingredient with the carriers and performing an arbitrary method known in the pharmaceutical technical field. The therapeutic drug is not limited by the type of usage as long as the therapeutic drug is used for treatment. The therapeutic drug may be the active ingredient alone or may be a mixture of the active ingredient and an arbitrary ingredient. The carriers are not particularly limited by their forms and may be, for example, solids or liquids (e.g., buffer solutions). The therapeutic drug for malignant tumor includes a drug for use in the prevention of malignant tumor (prophylactic drug) or a growth suppressor of malignant tumor cells.

In the present specification, "prevention" of a certain disease or disorder (e.g., malignant tumor) refers to protection against occurrence of such a condition before occurrence of this condition. Diagnosis is conducted using the agent of the present invention, and the prevention of, for example, malignant tumor, or measures for the prevention can be carried out using the agent of the present invention according to the need.

In the present specification, "prophylactic drug (agent)" refers to every agent that permits prevention of a targeted condition (e.g., a disease such as malignant tumor) in a broad sense.

In the present specification, "interaction" when two substances are mentioned means that force (e.g., intermolecular force (van der Waals attraction), a hydrogen bond, and hydrophobic interaction) works between one of the substances and the other substance. Usually, two substances that have interacted with each other are in an associated or bound state. The detection, the testing, and the diagnosis of the present invention can be achieved through the use of such interaction.

The term "binding" used herein means the physical interaction or chemical interaction between two substances or between their combinations. The binding includes an ionic bond, a non-ionic bond, a hydrogen bond, van der Waals binding, hydrophobic interaction, and the like. The physical interaction (binding) can be direct or indirect. The indirect binding is mediated by or attributed to the effects of another protein or compound. The direct binding refers to interaction that is neither mediated by nor attributed to the effects of another protein or compound and involves no other substantial chemical intermediates.

Thus, in the present specification, "agent" (or a detecting agent, etc.) "specifically" interacting with (or binding to) a biological agent such as a polynucleotide or a polypeptide encompasses an agent whose affinity for the biological agent such as the polynucleotide or the polypeptide is typically equivalent to or higher, preferably significantly (e.g., statistically significantly) higher, than its affinity for other unrelated polynucleotides or polypeptides (particularly, having less than 30% identity). Such affinity can be measured by, for example, hybridization assay or binding assay.

In the present specification, the phrase "first substance or agent "specifically" interacts with (or binds to) a second substance or agent" means that the first substance or agent interacts with (or binds to) the second substance or agent with higher affinity than that for substances or agents other than the second substance or agent (particularly, other substances or agents present in a sample containing the second substance or agent). Examples of the specific interaction (or binding) between substances or agents include, but are not limited to: the reactions between nucleic acids or proteins, such as hybridization for the nucleic acids, and antigen-antibody reaction and enzyme-substrate reaction for the proteins; and protein-lipid interaction and nucleic acid-lipid interaction. Thus, in the case where both of the substances or agents are nucleic acids, the "specific interaction" of the first substance or agent with the second substance or agent encompasses the case where the first substance or agent has complementarity to at least a portion of the second substance or agent. Alternatively, in the case where both of the substances or agents are proteins, examples of the "specific" interaction (or binding) of the first substance or agent with (or to) the second substance or agent include, but are not limited to, interaction through antigen-antibody reaction, interaction through receptor-ligand reaction, and enzyme-substrate interaction. In the case where two types of substances or agents comprise proteins and nucleic acids, the "specific" interaction (or binding) of the first substance or agent with (or to) the second substance or agent encompasses the interaction (or binding) between an antibody and its antigen. An analyte in a sample can be detected or quantified through the use of the reaction of such specific interaction or binding.

In the present specification, "detection" or "quantification" of polynucleotide or polypeptide expression can be achieved by use of an appropriate method including, for example, mRNA assay and immunological assay methods involving binding to or interaction with a detecting agent, a testing agent, or a diagnostic agent. Examples of the molecular biological assay method include Northern blot, dot blot, and PCR. Examples of the immunological assay method include methods such as ELISA using microtiter plates, RIA, fluorescence immunoassay, luminescence immunoassay (LIA), immunoprecipitation (IP), single radial immunodiffusion (SRID), turbidimetric immunoassay (TIA), Western blot, and immunohistological staining. Examples of the quantification method include ELISA and RIA. The detection or the quantification may be performed by a gene analysis method using an array (e.g., a DNA array and a protein array). The DNA array is broadly reviewed in (Gakken Medical Shujunsha Co., Ltd. ed., Cell Engineering, Suppl., "DNA microarray and latest PCR methods"). The protein array is described in detail in Nat Genet. 2002 December; 32 Suppl: 526-532. Examples of the gene expression analysis method include, but are not limited to, RT-PCR, RACE, SSCP, immunoprecipitation, two-hybrid systems, and in vitro translation, in addition to those mentioned above. Such an additional analysis method is described in, for example, Genomu Kaiseki Jikken Ho (Experimental Methods for Genomic Analysis in English), Nakamura Lab Manual, Yusuke Nakamura, ed., Yodosha Co., Ltd. (2002), the description of which is incorporated herein by reference in its entirety.

In the present specification, "expression level" refers to the amount of a polypeptide or mRNA, etc. expressed in intended cells, tissues, or the like. Examples of such an expression level include the expression level at the protein level of the polypeptide of the present invention evaluated by any appropriate method including an immunological assay method such as ELISA, RIA, fluorescence immunoassay, Western blot, or immunohistological staining using the antibody of the present invention, and the expression level at the mRNA level of the polypeptide of the present invention evaluated by any appropriate method including a molecular biological assay method such as Northern blot, dot blot, or PCR. "Change in expression level" means increase or decrease in the expression level at the protein or mRNA level of the polypeptide of the present invention evaluated by any appropriate method including the immunological assay method or molecular biological assay method described above. The expression level of a certain marker can be measured to thereby variously conduct detection or diagnosis based on the marker.

In the present specification, "decrease" or "suppression", or its synonym of activity or an expression product (e.g., a protein and a transcript (RNA, etc.)) refers to decrease in the amount, quality, or effect of the particular activity, transcript, or protein, or decreasing activity thereagainst. In the case where the decrease results in "disappearance", the decrease means that the activity, the expression product, etc. becomes less than the detection limit, and is also particularly referred to as "disappearance". In the present specification, "disappearance" is encompassed by "decrease" or "suppression".

In the present specification, "increase" or "activation", or its synonym of activity or an expression product (e.g., a protein and a transcript (RNA, etc.)) refers to increase in the amount, quality, or effect of the particular activity, transcript, or protein, or increasing activity thereagainst.

In the present specification, "in vivo" refers to the inside of a living body. In a particular context, "in vivo" refers to a position at which an intended substance should be located.

In the present specification, "in vitro" refers to a state in which a portion of a living body is extracted or liberated to the "outside of the living body" (e.g., into a test tube) for various studies. This term makes a contrast with the term "in vivo".

In the present specification, "ex vivo" refers to a series of operations when a certain procedure is performed outside the body and the resultant is intended to be then brought back to the body. In the present invention as well, an embodiment is possible in which cells present in a living body are treated with the agent of the present invention and then brought back to the patient.

In the present specification, "combined use" of a certain pharmaceutical ingredient (e.g., the antibody of the present invention, for example, the anti-FSTL1 antibody) with another pharmaceutical ingredient (e.g., the anti-CTLA4 antibody) is intended to include concurrent (coexistent) administration and continuous administration. The continuous administration is intended to encompass the administration of one or more therapeutic agents and one or more antibodies, etc. of the present invention to a recipient in various orders.

An agent or drug for administration by "combined use" of a certain pharmaceutical ingredient (e.g., the antibody of the present invention, for example, the anti-FSTL1 antibody) with another pharmaceutical ingredient (e.g., the anti-CTLA4 antibody) is also called "combination drug".

In the present specification, "kit" usually refers to a unit by which parts to be provided (e.g., a testing drug, a diagnostic drug, a therapeutic drug, an antibody, a label, and a written explanation) are provided in two or more divided compartments. This kit form is preferred when the parts should not be provided as a mixture for stability or the like and are intended to be mixed immediately before use to provide a preferred composition. For such a kit, it is advantageous to comprise, preferably, an instruction manual or a written explanation that describes how to use the parts to be provided (e.g., a testing drug, a diagnostic drug, and a therapeutic drug or how to treat reagents. In the present specification, in the case of using the kit as a reagent kit, the kit usually comprises an instruction manual or the like that describes how to use a testing kit, a diagnostic drug, a therapeutic drug, an antibody, etc.

In the present specification, "instruction manual" is a statement that explains a method used in the present invention to physicians or other users. This instruction manual describes words providing instructions for the detection method of the present invention, how to use a diagnostic drug, or the administration of a medicament or the like. Also, the instruction manual may describe words providing instructions for oral administration or administration to the esophagus (e.g., by injection) as an administration route. This instruction manual is prepared according to a format specified by regulatory authorities of a country (e.g., Ministry of Health, Labour and Welfare for Japan and Food and Drug Administration (FDA) for the U.S.A) where the present invention is executed, and stipulates that approval by the regulatory authorities has been received. The instruction manual is a so-called package insert and is usually provided in a paper version, though the instruction manual is not limited thereto. The instruction manual may be provided in the form of, for example, an electronic medium (e.g., homepage provided by the Internet, and e-mail).

Preferred Embodiments

Hereinafter, preferred embodiments of the present invention will be described. It is understood that the embodiments provided below are given for well understanding the present invention, and the scope of the present invention should not be limited to the description below. Thus, it is evident that those skilled in the art can appropriately make change or modification within the scope of the present invention in light of the description of the present specification. It is also understood that the following embodiments of the present invention can each be used alone or can be used in combination.

(Anti-FSTL1 Antibody)

In one aspect, the present invention provides an anti-FSTL1 antibody or a fragment or functional equivalent thereof (also collectively referred herein to as "anti-FSTL1 antibody, etc." or "antibody, etc. of the present invention"), wherein the antibody recognizes an epitope in a region selected from the group consisting of amino acid positions 48 to 100, 148 to 170 or 148 to 162, 193 to 228 or 193 to 216, 205 to 228, and 233 to 289 or 272 to 289 of SEQ ID NO: 504 (amino acid sequence of human FSTL1). In a preferred embodiment, the antibody recognizes an epitope in a region of amino acid positions 148 to 162 or 272 to 289 of SEQ ID NO: 504 (amino acid sequence of human FSTL1).

For the antibody according to the present invention, the epitope can correspond to a region of consecutive or non-consecutive 5 or more amino acids, 6 or more amino acids, 7 or more amino acids, 8 or more amino acids, 9 or more amino acids, 10 or more amino acids, 11 or more amino acids, or 12 or more amino acids in the region concerned, or a combination thereof.

In a preferred embodiment, the antibody for the anti-FSTL1 antibody of the present invention or the fragment or functional equivalent thereof recognizes an epitope in a region selected from the group consisting of amino acid positions 48 to 100, 148 to 162, 205 to 228, and 272 to 289 of SEQ ID NO: 503 (amino acid sequence of human FSTL1). These epitopes include those for which drug efficacy has been confirmed in animal tests. It is understood that #6-55, #7-34, and #13 recognize the 148-162 site. It is also understood that #5-2, #5-3, #5-8, #5-10, #5-43, #8-1, #8-4, #8-6, and #8-8 recognize amino acid positions 272 to 289. It is understood that #7 and #10 recognize amino acid positions 205 to 228. It is understood that #22 recognizes amino acid positions 193 to 216. It is understood that #33 recognizes amino acid positions 48 to 100. Further preferably, the antibody for the anti-FSTL1 antibody of the present invention or the fragment or functional equivalent thereof recognizes an epitope in a region selected from the group consisting of amino acid positions 148 to 162 and 205 to 228 of SEQ ID NO: 503 (amino acid sequence of human FSTL1). These epitopes include those recognized by antibodies confirmed to have stronger activity. In another preferred embodiment, the antibody recognizes an epitope in a region of amino acid positions 48 to 100, 148 to 162, or 205 to 228 of SEQ ID NO: 504 (amino acid sequence of human FSTL1). Although not wishing to be bound by any theory, these epitopes include those for which drug efficacy has been confirmed in in vitro or in vivo tests.

In an alternative embodiment, the antibody for the anti-FSTL1 antibody of the present invention or the fragment or functional equivalent thereof has particular CDR. Alternatively, the anti-FSTL1 antibody of the present invention or the fragment or functional equivalent thereof may be an antibody comprising an arbitrary sequence comprising a full-length CDR sequence, or an antigen binding fragment thereof, or an antibody comprising the variable region of a sequence related to a particular antibody of the present invention, or an antigen binding fragment thereof, wherein a framework region thereof contains the substitution, addition, or deletion of 1, 2, 3, 4, 5, 6, 7, 8, 9, 10, 12, 15, 17, or 20 or more amino acids. More specifically, as for such particular CDR, the antibody comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of antibody #5-2 (light chain: SEQ ID NO: 508; heavy chain: SEQ ID NO: 510), #5-3 (light chain: SEQ ID NO: 512; heavy chain: SEQ ID NO: 514), antibody #5-8 (light chain: SEQ ID NO: 516; heavy chain: SEQ ID NO: 518), #5-10 (light chain: SEQ ID NO: 520; heavy chain: SEQ ID NO: 522), #5-43 (light chain: SEQ ID NO: 524; heavy chain: SEQ ID NO: 526), #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #8-4 (light chain: SEQ ID NO: 540; heavy chain: SEQ ID NO: 542), #8-7 (light chain: SEQ ID NO: 544; heavy chain: SEQ ID NO: 546), #8-8 (light chain: SEQ ID NO: 548; heavy chain: SEQ ID NO: 550), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562), #22 (light chain: SEQ ID NO: 564; heavy chain: SEQ ID NO: 566) and #33 (light chain: SEQ ID NO: 568; heavy chain: SEQ ID NO: 570) or functional equivalents thereof (e.g., containing the conservative substitution of 1, 2, or 3 or more amino acids) as specific examples of heavy chain CDR1, CDR2, and CDR3 and light chain CDR1, CDR2, and CDR3. Alternatively, the anti-FSTL1 antibody of the present invention or the fragment or functional equivalent thereof may be a mutant of the antibody, wherein the mutant contains the substitution, addition, or deletion of 1 or several amino acids in a framework of the antibody but contains no mutation in the CDR. Embodiments described in another section herein and/or an approach known in the art can be used in the production of the antibody, etc. For the treatment or prevention of the present invention, it is preferred that such an antibody or a fragment or functional equivalent thereof should have suppressive activity against FSTL1 or a signaling pathway downstream therefrom. Such activity may be confirmed by examining the expression level of FSTL1 or its activity, or by directly using a cancer cell line and examining, for example, the inhibition of cell growth, the inhibition of metastatic activity, the inhibition of bone metastasis, the inhibition of the activity of enhancing immune defect such as immunosuppression or immunodeficiency by MSCs (e.g., growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity), the inhibition of imparting of immunosuppressive or immunodeficient properties to immune-related cells (e.g., growth of regulatory T cells, increase in the immunosuppressive activity of regulatory T cells, differentiation into regulatory T cells, growth of regulatory dendritic cells, increase in the immunosuppressive activity of regulatory dendritic cells, differentiation into regulatory dendritic cells, growth of tolerogenic dendritic cells, increase in the immunosuppressive activity of tolerogenic dendritic cells, differentiation into tolerogenic dendritic cells, growth of myeloid-derived suppressor cells, increase in the immunosuppressive activity of myeloid-derived suppressor cells, differentiation into myeloid-derived suppressor cells, growth of exhausted T cells, enhancement of the immunodeficient activity of exhausted T cells, and expansion of exhausted T cells caused by growth, induction, etc. of exhausted T cells, cytotoxic activity by antibody-dependent cellular cytotoxicity (ADCC), or observed retraction of tumor implanted in model animals.

An approach therefor is well known in the art, and an approach used herein may be used. In a particular embodiment, such an antibody of the present invention can be an antibody selected from a monoclonal antibody, a polyclonal antibody, a chimeric antibody, a humanized antibody, a human antibody, a multifunctional antibody, a bispecific or oligospecific antibody, a single-chain antibody, scFv, diabody, sc(Fv)2 (single chain (Fv)2), and scFv-Fc.

Herein, the amino acid sequences of CDRs of each antibody clone are underlined in the sequences of heavy and light chains.

5-2:

Light chain (L chain; SEQ ID NO: 508): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRGSGSKSGSTATLTITGVQAEDEAVYFCGGYDSSTGHGGIFGAG

TTLTVL

Heavy chain 'H chain; SEQ ID NO: 510): CDRs are underlined, and CDR1, CDR2, and CDR3 are shown in order from the N terminus.

AVTLDESGGGLQTPGGGLSLVCKGSGFTFSSFNMFWVRQAPGKGLEWVAG

VGKDGGTGYGAAVDGRATISKDNGQSTLRLQLNNLRAEDTGTYYCAKAAG

GCSYGWCGSYVGDIDAWGHGTEVIVSS

5-3

L chain (SEQ ID NO: 512): CDRs are underlined, and CDR1, CDR2, and CDR3 are shown in order from the N terminus.

ASTQPSSVSANPGETVKITCSGGSGYYYGWYQQKSPGSVPVTVIYNNNNR

PSDIPSRFSGSKSGSTGTLTITGVRAEDEAVYYCGGYDNSGTGIFGAGTT

LTVL

H chain (SEQ ID NO: 514): CDRs are underlined, and CDR1, CDR2, and CDR3 are shown in order from the N terminus.

AVTLDESGGGLQTPGGALSLVCKGSGFSFSSFNMFWVRQAPGKGLEWVAG

IGKDGVPKYGAAVDGRATISKDNGQSTMRLQLNNLRAEDTGTYFCAKAAG

GCSYDWCGIYAGDIDTWGHGTEVIVSS

5-8

L chain (SEQ ID NO: 516): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRFSGSKSGSTATLTITGVQAEDEAVYFCGGYDSSTGHGGIFGAG

TTLTVL

H chain (SEQ ID NO: 518): CDRs are underlined, and CDR1, CDR2, and CDR3 are shown in order from the N terminus.

AVTLDESGGGLQTPGGGLSLVCKGSGFTFSSFNMFWVRQAPGKGLEWVAG

IGKDGVPKYGTAVDGRATISKDNGQSTMRLQLNNLRAEDTGTYFCAKAAG

GCSYDWCGIYTGDIDTWGHGTEVIVSS

5-10
L chain (SEQ ID NO: 520): CDRs are underlined, and CDR1, CDR2, and CDR3 are shown in order from the N terminus.

ASTQPSSVSANPGETVKITCSGGGSYVGSYYYGWYQQKSPGSAPVTVIYN

NNQRPSDIPSRFSGSKSGSTATLTITGVQAEDEAVYFCGGYDSSAGGIFG

AGTTLTVL

H chain (SEQ ID NO: 522): CDRs are underlined, and CDR1, CDR2, and CDR3 are shown in order from the N terminus.

AVTLDESGGGLQTPGGGLSLVCKGSGFTLSSFNMFWVRQAPGKGLEWVAG

VGKDGGTTYGAAVDGRATISRDSGQSTVRLQLNDLRAEDTGTYFCAKAAG

GCSYWCGAYVGDLDAWGHGTEVIVSS

5-43
L chain (SEQ ID NO: 524): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRFSGSKSGSTATLTITGVQAEDEAVYFCGGYDSSTGHGGIFGAG

TTLTVL

H chain (SEQ ID NO: 526): CDRs are underlined, and CDR1, CDR2, and CDR3 are shown in order from the N terminus.

AVTLDESGGGLQTPGGGLSLVCKGSGFTFSSFNMFWVRQAPGKGLEWVAG

IGKDGGTGYGAAVDGRATISKDSGQSTLRLQLNNLRAEDTGTYYCAKAAG

GCSYDWCGAYTGDIDTWGHGTEVIVSS

6-55
L chain (SEQ ID NO: 528): CDRs are underlined, and CDR1, CDR2, and CDR3 are shown in order from the N terminus.

ASTQPSSVSAIPGETVKITCSGGGNNYGWYQQRSPGSAPVTVIYYNDNRP

SNIPSRFSGSTSGSTSTLTITGVQADDEAIYYCGSWDSNTDSGIFGAGTT

LTVL

H chain (SEQ ID NO: 530): CDRs are underlined, and CDR1, CDR2, and CDR3 are shown in order from the N terminus.

AVTLDESGGGLQTPGGALSLVCKGSGFTFSVTMQWVRQAPGKGLEWVAS

VCSGSSTYYAPAVKGRATISRDNGQSTVRLQLSNLRPEDTGTYYCAKIAG

RARWSCTSAAYNIDAWGHGTEVIVSS

7-34
L chain (SEQ ID NO: 532): CDRs are underlined, and CDR1, CDR2, and CDR3 are shown in order from the N terminus.

ASTQPSSVSANPGETVKITCSGGGNNYGWYQQKSPGSAPVTVIYYNNNRP

SNIPSRFSGSTSGSTSTLTITGVQAEDEAVYYCGSYEGSTDSGIFGAGTT

LTVL

H chain (SEQ ID NO: 534): CDRs are underlined, and CDR1, CDR2, and CDR3 are shown in order from the N terminus.

AVTLDESGGGLQTPGGGLSLVCKASGFTFSSVTMQWVRQAPGKGLSWVAS

ICSGSSTYYGPAVKGRATISRDNGQNTVRLQLNNLRAEDTATYYCAKIVG

RGRWSCTSAAYNIDAWGHGTEVIVSS

8-1
L chain (SEQ ID NO: 536): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRFSGSKSGSTATLTITGVQAEDEAVYFCGGYDSSSGHGGIFGAG

TTLTVL

H chain (SEQ ID NO: 538): CDRs are underlined, and CDR1, CDR2, and CDR3 are shown in order from the N terminus.

AVTLDESGGGLQTPGGALSLVCKGSGFTFSSFNMFWVRQAPGKGLEWVAG

IGKDGVPKYGAAVDGRATISKDKGQSTMRLQLNNLRAEDTGTYFCAKAAG

GCSYDWCGIYAGDIDTWGHGTEVIVSS

8-4
L chain (SEQ ID NO: 540): CDRs are underlined, and CDR1, CDR2, and CDR3 are shown in order from the N terminus.

ASSQPSSVSANPGETVKITCSGGSGYYYGWYQQKSPGSAPVTVIYNNDNK

PSDIPSRFSGSKSGSTGTLTITGVQVEDEAVYFCGGYDNSGTGIFGAGTT

LTVL

H chain (SEQ ID NO: 542): CDRs are underlined, and CDR1, CDR2, and CDR3 are shown in order from the N terminus.

AVTLDESGGGLQTPGGGLSLVCKGSGFTLSSFNMFWVRQAPGKGLEWVAG

VGKDGGTAYGAAVDGRATISRDSGQSTVRLQLNNLRAEDTGTYFCAKAAG

GCSYSWCGAYVGDLDAWGHGTEVIVSS

8-7
L chain (SEQ ID NO: 544): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRFSGSKSGSTATLTITGVQAEDEAVYFCGGYDSSTGHGGIFGAG

TTLTVL

H chain (SEQ ID NO: 546): CDRs are underlined, and CDR1, CDR2, and CDR3 are shown in order from the N terminus.

AVTLDESGGGLQTPGGGLSLVCKGSGFTFSSFNMFWVRQAPGKGLEWVAG

IGKDGVPKYGAAVDGRATISKDNGQSTLRLQLNNLRAEDTGTYFCAKAAG

GCSYDWCGIYAGDIDTWGHGTEVIVSS

8-8
L chain (SEQ ID NO: 548): CDRs are underlined, and CDR1, CDR2, and CDR3 are shown in order from the N terminus.

ASTQPSSVSANPGEAVKITCSGGSGSYYGWYQQKSPGSAPVTVIYNNNQR

PSDIPSRFSGSKSGSTATLTITGVQVEDEAVYFCGGYDSSTGHGGIFGAG

TTLTVL

H chain (SEQ ID NO: 550): CDRs are underlined, and CDR1, CDR2, and CDR3 are shown in order from the N terminus.

ACTLDESGGGLQTPGGALSLVCKGSGFTFSSFNMFWVRQAPGKGLEWVAG

IGKDGVPKYGAAVDGRATISKDNGQSTMRLQLNNLRAEDTGTYYCAKAAG

GCSYGWCGAYTGDIDTWGHGTEVIVSS

7
L chain (SEQ ID NO: 552): CDRs are underlined, and CDR1, CDR2, and CDR3 are shown in order from the N terminus.

ASTQPSSVSANPGETVKITCSGGGSRYGWYQQKSPGSAPVTVIYYNDKRP

SNIPSRFSGSKSGSTGTLTITGVRAEDEAVYFCGGYDGSTDAAFGAGTTL

TVL

H chain (SEQ ID NO: 554): CDRs are underlined, and CDR1, CDR2, and CDR3 are shown in order from the N terminus.

AVTLDESGGGLQTPGGALSLVCKASGFFFFSIYDMGWVRQAPGKGLEWVA

GIDDYGEYTGYGSAVKGRATISRDNGQSTVRLQLNNLRAEDTGTYYCARG

AGTGCNSAGCGAYAGSIDAWGHGTEVIVSP

10
L chain (SEQ ID NO: 556): CDRs are underlined, and CDR1, CDR2, and CDR3 are shown in order from the N terminus.

ASTQPSSVSANPGETVKLTCSGGGSRYGWYQQKSPGSAPVTVIYYNDKRP

SDIPSRFSGSKSGSTATLTITGVQAEDEAVYFCGGYDGSRDAGIFGAGTT

LTVL

H chain (SEQ ID NO: 558): CDRs are underlined, and CDR1, CDR2, and CDR3 are shown in order from the N terminus.

AVTLDESGGGLQTPGGALSLVCKASGFFFFRIYDMGWVRQAPGKGLEWVA

GIDDYGRYTGYGSAVKGRATISRDNGQSTVRLQLNNLRAEDTGTYYCARG

AGTGCNSAGCGAYAGSIDAWGHGTEVIVSS

13
L chain (SEQ ID NO: 560): CDRs are underlined, and CDR1, CDR2, and CDR3 are shown in order from the N terminus.

ASTQPSSVSANPGETVKITCSGGGNNYGWYQQKSPGSAPVTVIYNNNNRP

SNIPSRFSGSKSGSTNTLTITGVQAEDEAVYYCGSYDSSSDSGIFGAGTT

LTVL

H chain (SEQ ID NO: 562): CDRs are underlined, and CDR1, CDR2, and CDR3 are shown in order from the N terminus.

AVTLDESGGGLQTPGGGLSLVCKASGFTFSSVTMQWVRQAPGKGLEWVAS

ICSGSSTYYGPAVKGRATISRDNGQNTVRLQLNNLRAEDTATYYCAKIVG

RGRWSCTSAAYNIDAWGHGTEVIVSS

22
L chain (SEQ ID NO: 564): CDRs are underlined, and CDR1, CDR2, and CDR3 are shown in order from the N terminus.

ASTQPSSVSANPGETVKITCSGGSGSYGWFQQKSPGSAPVTVIYWDDRRP

SDIPSRFSGSKSGSIHTLTITGVQADDEAVYLCGNAVRSGTGYVGVFGAG

TTLTVL

H chain (SEQ ID NO: 566): CDRs are underlined, and CDR1, CDR2, and CDR3 are shown in order from the N terminus.

AVTLDESGGGLQTPGGALSLVCKASGFTFSSNGMAWVRQAPGKGLELVAR

INSSGSYTNYGAAVKGRATISRDNGQSTVRLQLNNLRAEDTGTYYCAKGA

SGYGAYPGNIDAWGHGTEVIVSS

33
L chain (SEQ ID NO: 568): CDRs are underlined, and CDR1, CDR2, and CDR3 are shown in order from the N terminus.

ASTQPSSVSANPGETVEITCSGDSSYYGWFQQKSPGSAPVTVIYDNTNRP

SDIPSRFSGSKSGSTATLTITGVRAEDEAVYYCGGYDSSTYDGIFGAGTT

LTVL

H chain (SEQ ID NO: 570): CDRs are underlined, and CDR1, CDR2, and CDR3 are shown in order from the N terminus.

```
AVTLDESGGGLQTPGGGLSLVCKASGFTFSSFNMNWVRQAPGKGLEYVAE

ISGTGSSTYYGSAVKGRATISRDNGQSTVRLQLNNLRAEDTATYFCARGD

GAYSIDAWGHGTEVIVVS
```

In a preferred embodiment, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or functional equivalents thereof (e.g., containing the conservative substitution of 1, 2, or 3 or more amino acids). In these clones, stronger binding activity against FSTL1 was observed in Examples. It is understood that a clone carrying similar CDRs is expected to maintain this stronger binding activity, and exerts similar drug efficacy.

Further preferably, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 528; heavy chain: SEQ ID NO: 530), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or functional equivalents thereof (e.g., containing the conservative substitution of 1, 2, or 3 or more amino acids). In these clones, stronger drug efficacy was observed in Examples. It is understood that a clone carrying similar CDRs is expected to maintain this stronger drug efficacy.

In an alternative embodiment, the antibody for the anti-FSTL1 antibody of the present invention or the fragment or functional equivalent thereof has particular full-length variable regions. Such particular variable regions include the full-length variable regions of antibody #5-2 (light chain: SEQ ID NO: 508; heavy chain: SEQ ID NO: 510), #5-3 (light chain: SEQ ID NO: 512; heavy chain: SEQ ID NO: 514), antibody #5-8 (light chain: SEQ ID NO: 516; heavy chain: SEQ ID NO: 518), #5-10 (light chain: SEQ ID NO: 520; heavy chain: SEQ ID NO: 522), #5-43 (light chain: SEQ ID NO: 524; heavy chain: SEQ ID NO: 526), #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #8-4 (light chain: SEQ ID NO: 540; heavy chain: SEQ ID NO: 542), #8-7 (light chain: SEQ ID NO: 544; heavy chain: SEQ ID NO: 546), #8-8 (light chain: SEQ ID NO: 548; heavy chain: SEQ ID NO: 550), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562), #22 (light chain: SEQ ID NO: 564; heavy chain: SEQ ID NO: 566) and #33 (light chain: SEQ ID NO: 568; heavy chain: SEQ ID NO: 570) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises the full-length variable regions of an antibody selected from the group consisting of #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or functional equivalents thereof (e.g., containing the conservative substitution of 1, 2, or 3 or more amino acids). In a preferred embodiment, the antibody for the anti-FSTL1 antibody of the present invention or the fragment or functional equivalent thereof comprises the full-length variable regions of an antibody selected from the group consisting of antibody #6-55 (light chain: SEQ ID NO: 528; heavy chain: SEQ ID NO: 530), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises a full-length antibody selected from the group consisting of antibody #5-2 (light chain: SEQ ID NO: 598; heavy chain: SEQ ID NO: 600), #5-3 (light chain: SEQ ID NO: 602; heavy chain: SEQ ID NO: 604), antibody #5-8 (light chain: SEQ ID NO: 606; heavy chain: SEQ ID NO: 608), #5-10 (light chain: SEQ ID NO: 610; heavy chain: SEQ ID NO: 612), #5-43 (light chain: SEQ ID NO: 614; heavy chain: SEQ ID NO: 616), #6-55 (light chain: SEQ ID NO: 618; heavy chain: SEQ ID NO: 620), #7-34 (light chain: SEQ ID NO: 622; heavy chain: SEQ ID NO: 624), #8-1 (light chain: SEQ ID NO: 626; heavy chain: SEQ ID NO: 628), #8-4 (light chain: SEQ ID NO: 630; heavy chain: SEQ ID NO: 632), #8-7 (light chain: SEQ ID NO: 634; heavy chain: SEQ ID NO: 636), #8-8 (light chain: SEQ ID NO: 638; heavy chain: SEQ ID NO: 640), #7 (light chain: SEQ ID NO: 642; heavy chain: SEQ ID NO: 644), #10 (light chain: SEQ ID NO: 646; heavy chain: SEQ ID NO: 648), #13 (light chain: SEQ ID NO: 650; heavy chain: SEQ ID NO: 652), #22 (light chain: SEQ ID NO: 654; heavy chain: SEQ ID NO: 656) and #33 (light chain: SEQ ID NO: 658; heavy chain: SEQ ID NO: 660) or a humanized sequence thereof.

In a preferred embodiment, the antibody for the anti-FSTL1 antibody of the present invention or the fragment or functional equivalent thereof comprises a full-length antibody selected from the group consisting of antibody 6-55 (light chain: SEQ ID NO: 618; heavy chain: SEQ ID NO: 620), #7-34 (light chain: SEQ ID NO: 622; heavy chain: SEQ ID NO: 624), #8-1 (light chain: SEQ ID NO: 626; heavy chain: SEQ ID NO: 628), #7 (light chain: SEQ ID NO: 642; heavy chain: SEQ ID NO: 644), #10 (light chain: SEQ ID NO: 556; heavy chain: SEQ ID NO: 558), #13 (light chain: SEQ ID NO: 650; heavy chain: SEQ ID NO: 652) and #33 (light chain: SEQ ID NO: 658; heavy chain: SEQ ID NO: 660) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 528; heavy chain: SEQ ID NO: 530), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or a humanized sequence thereof.

In a preferred embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 671, 673, 675, and 677, respectively) and L chain FR1, FR2, FR3, and FR4 (SEQ ID NOs: 687, 689, 691, and 693, respectively) of H(2)-L(1).

In a preferred embodiment, the humanized antibody of the present invention has a heavy chain framework sequence comprising SEQ ID NOs: 663, 665, 667, and 669 (humanized heavy chain sequence FR1, FR2, FR3, and FR4 of H(1)), SEQ ID NOs: 671, 673, 675, and 677 (humanized heavy chain sequence FR1, FR2, FR3, and FR4 of H(2)), or SEQ ID NOs: 679, 681, 683, and 685 (humanized heavy chain sequence FR1, FR2, FR3, and FR4 of H(3)), and a light chain framework sequence comprising SEQ ID NOs: 687, 689, 691, and 693 (humanized light chain sequence FR1, FR2, FR3, and FR4 of L(1)), SEQ ID NOs: 733, 735, 737, and 739 (humanized light chain sequence FR1, FR2, FR3, and FR4 of L(2)), or SEQ ID NOs: 741, 743, 745, and 747 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 708, 709, 710, and 711, respectively) and light chain sequence FR1, FR2, FR3, and FR4 (SEQ ID NOs: 712, 713 or 716, 714 or 717, and 715, respectively) of corresponding chicken sequences, into amino acids in each of the chicken sequences. Preferably, the heavy chain framework sequence of H(2), i.e., SEQ ID NOs: 671, 673, 675, and 677 (humanized heavy chain sequence FR1, FR2, FR3, and FR4 of H(2)), or a sequence obtained by the mutation (back mutation) of one or more differing amino acids in the heavy chain framework sequence from heavy chain sequence FR1, FR2, FR3, and FR4 of a corresponding chicken sequence, into amino acids in the chicken sequence can be used. In the present specification, this is because use of H(2) was superior in activity by an order of magnitude in terms of KD value to H(1) and H(3). Also preferably, a light chain framework sequence comprising SEQ ID NOs: 687, 689, 691, and 693 (humanized light chain sequence FR1, FR2, FR3, and FR4, respectively, of L(1)) or a sequence obtained by the mutation (back mutation) of one or more differing amino acids in the light chain framework sequence from corresponding chicken light chain sequence FR1, FR2, FR3, and FR4 (SEQ ID NOs: 712, 713 or 716, 714 or 717, and 715, respectively) into amino acids in the chicken sequence can be used.

Further preferably, the humanized antibody has a heavy chain framework sequence comprising SEQ ID NOs: 663, 665, 667, and 669 (humanized heavy chain sequence FR1, FR2, FR3, and FR4 of H(1)), SEQ ID NOs: 671, 673, 675, and 677 (humanized heavy chain sequence FR1, FR2, FR3, and FR4 of H(2)), or SEQ ID NOs: 679, 681, 683, and 685 (humanized heavy chain sequence FR1, FR2, FR3, and FR4 of H(3)), or a sequence obtained by the mutation of 1 to 8 (e.g., 1, 2, 3, 4, 5, 6, 7, or 8) differing amino acids in the heavy chain framework sequence from corresponding chicken heavy chain sequence FR1, FR2, FR3, and FR4 (SEQ ID NOs: 708, 709, 710, and 711, respectively) into amino acids in the chicken sequence, and has a light chain framework sequence comprising SEQ ID NOs: 687, 689, 691, and 693 (humanized light chain sequence FR1, FR2, FR3, and FR4 of L(1)), SEQ ID NOs: 733, 735, 737, and 739 (humanized light chain sequence FR1, FR2, FR3, and FR4 of L(2)), or SEQ ID NOs: 741, 743, 745, and 747 (humanized light chain sequence FR1, FR2, FR3, and FR4 of L(3)), or a sequence obtained by the mutation of 1 to 4 (e.g., 1, 2, 3, or 4) differing amino acids in the light chain framework sequence from corresponding chicken light chain sequence FR1, FR2, FR3, and FR4 (SEQ ID NOs: 712, 713 or 716, 714 or 717, and 715, respectively) into amino acids in the chicken sequence. In a preferred embodiment, at least 1, more preferably at least 2, at least 3, at least 4, or at least 5 differing amino acids that are taken into consideration for the back mutation of the humanized antibody are selected from Vernier residues. It is understood that the mutation may involve amino acid residues other than the Vernier residues as long as the activity is optimized. In a preferred embodiment, all of the differing amino acids are selected from Vernier residues. For the Vernier residue, see, for example, Japanese Patent Laid-Open No. 2010-4895 and Nishibori N et al., Molecular Immunology 43 (2006) 634-642, the description of which is incorporated herein by reference.

The Vernier residues include FR1 amino acid (SEQ ID NO: 671) positions 28 and 30, FR2 amino acid (SEQ ID NO: 673) position 12, and FR3 amino acid (SEQ ID NO: 675) positions 2, 10, 13, 17, and 32 of the H chain of the humanized sequence, and FR1 (SEQ ID NO: 687) position 20 and FR3 amino acid (SEQ ID NO: 691) positions 10, 15, and 31 of the L chain. It is understood that the Vernier sequences may vary among different sequences.

In one embodiment, the antibody of the present invention is a humanized antibody having any of the H chain FR1, FR2, FR3, and FR4 and L chain FR1, FR2, FR3, and FR4 of H(1)-L(1), H(2)-L(1), H(3)-L(1), H(1)-L(2), H(2)-L(2), H(3)-L(2), H(1)-L(3), H(2)-L(3), or H(3)-L(3). In another embodiment, the antibody of the present invention is a humanized antibody having the H chain FR1, FR2, FR3, and FR4 (SEQ ID NOs: 671, 673, 675, and 677, respectively) and L chain FR1, FR2, FR3, and FR4 (SEQ ID NOs: 687, 689, 691, and 693, respectively) of H(2)-L(1).

In an alternative embodiment, the antibody of the present invention is a humanized antibody having a heavy chain framework sequence comprising SEQ ID NOs: 663, 665, 667, and 669 (humanized heavy chain sequence FR1, FR2, FR3, and FR4 of H(1)), SEQ ID NOs: 671, 673, 675, and 677 (humanized heavy chain sequence FR1, FR2, FR3, and FR4 of H(2)), or SEQ ID NOs: 679, 681, 683, and 685 (humanized heavy chain sequence FR1, FR2, FR3, and FR4 of H(3)), or a mutant containing the substitution, addition, and/or deletion of 1 to 10 amino acids thereof, and a light chain framework sequence comprising SEQ ID NOs: 687, 689, 691, and 693 (humanized light chain sequence FR1, FR2, FR3, and FR4 of L(1)), SEQ ID NOs: 733, 735, 737, and 739 (humanized light chain sequence FR1, FR2, FR3, and FR4 of L(2)), or SEQ ID NOs: 741, 743, 745, and 747 (humanized light chain sequence FR1, FR2, FR3, and FR4 of L(3)), or a mutant containing the substitution, addition, and/or deletion of 1 to 10 amino acids thereof.

In a further alternative embodiment, the antibody of the present invention is a humanized antibody comprising a framework sequence consisting of a heavy chain framework sequence comprising SEQ ID NOs: 663, 665, 667, and 669 (humanized heavy chain sequence FR1, FR2, FR3, and FR4 of H(1)), SEQ ID NOs: 671, 673, 675, and 677 (humanized heavy chain sequence FR1, FR2, FR3, and FR4 of H(2)), or SEQ ID NOs: 679, 681, 683, and 685 (humanized heavy chain sequence FR1, FR2, FR3, and FR4 of H(3)), and a light chain framework sequence comprising SEQ ID NOs: 687, 689, 691, and 693 (humanized light chain sequence FR1, FR2, FR3, and FR4), SEQ ID NOs: 733, 735, 737, and 739 (humanized light chain sequence FR1, FR2, FR3, and FR4 of L(2)), or SEQ ID NOs: 741, 743, 745, and 747 (humanized light chain sequence FR1, FR2, FR3, and FR4 of L(3)), or a sequence containing the substitution, addition, and/or deletion of 1 to 10 amino acids, 1 to 9 amino acids, 1 to 8 amino acids, 1 to 7 amino acids, 1 to 6 amino acids, 1 to 5 amino acids, 1 to 4 amino acids, 1 to 3 amino acids, or 1 or 2 amino acids in the framework sequence.

A transformant can be prepared by transfecting a cell with a polynucleotide or vector encoding the antibody for the anti-FSTL1 antibody according to one embodiment of the present invention or the fragment or functional equivalent thereof. Use of this transformant permits preparation of the antibody for the anti-FSTL1 antibody according to the embodiments of the present invention or the fragment or functional equivalent thereof. The transformant may be a human or non-human mammalian (e.g., rat, mouse, guinea pig, rabbit, bovine, and monkey) cell. Examples of the mammalian cell include Chinese hamster ovary cells (CHO cells) and monkey cells COS-7. Alternatively, the transformant may be a bacterium of the genus *Escherichia*, a yeast, or the like.

For example, an *E. coli*-derived plasmid (e.g., pET-Blue), a *Bacillus subtilis*-derived plasmid (e.g., pUB110), a yeast-derived plasmid (e.g., pSH19), an expression plasmid for animal cells (e.g., pA1-11 and pcDNA3.1-V5/His-TOPO), a bacteriophage such as λ phage, or a virus-derived vector can be used as the vector described above. These vectors may contain a constituent necessary for protein expression, such as a promoter, a replication origin, or an antibiotic resistance gene. The vector may be an expression vector.

For example, a calcium phosphate method, lipofection, electroporation, an adenovirus-based method, a retrovirus-based method, or microinjection can be used as a method for transfecting the cell with the polynucleotide or vector described above (Shin Idenshi Kogaku Handobukku (New Gene Engineering Handbook in English), revised 4th edition, Yodosha Co., Ltd. (2003): 152-179). For example, a method described in "Tanpakushitsu Jikken Handobukku (Protein Experiment Handbook in English), Yodosha Co., Ltd. (2003): 128-142" can be used as a method for producing the antibody using cells. For example, ammonium sulfate, ethanol precipitation, protein A, protein G, gel filtration chromatography, anion- or cation-exchange chromatography, phosphocellulose chromatography, hydrophobic interaction chromatography, affinity chromatography, hydroxyapatite chromatography, or lectin chromatography can be used in the purification of the antibody (Tanpakushitsu Jikken Handobukku (Protein Experiment Handbook in English), Yodosha Co., Ltd. (2003): 27-52).

(Medicament and Anticancer Agent)

In one aspect, the present invention provides a medicament comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the medicament of the present invention.

In this aspect, the present invention provides the anti-FSTL1 antibody of the present invention or the fragment or functional equivalent thereof for use as a medicament. It is understood that an antibody of an arbitrary embodiment or arbitrary example described herein in the section (Anti-FSTL1 antibody), etc. can be used as the antibody or the fragment or functional equivalent thereof for use in the medicament of the present invention.

In this aspect, the present invention provides a method for treating or preventing a FSTL1-related disease, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides an anticancer agent comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the anticancer agent of the present invention.

In this aspect, the present invention provides the anti-FSTL1 antibody of the present invention or the fragment or functional equivalent thereof for the treatment or prevention of cancer. It is understood that an antibody of an arbitrary embodiment or arbitrary example described herein in the section (Anti-FSTL1 antibody), etc. can be used as the antibody or the fragment or functional equivalent thereof for the treatment or prevention of cancer of the present invention.

In this aspect, the present invention provides a method for treating or preventing cancer, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides a therapeutic or prophylactic agent for metastatic malignant tumor or metastasis of malignant tumor, comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof for the metastatic malignant tumor of the present invention.

In this aspect, the present invention provides the anti-FSTL1 antibody of the present invention or the fragment or functional equivalent thereof for the treatment or prevention of metastatic malignant tumor or metastasis of malignant tumor. It is understood that an antibody of an arbitrary embodiment or arbitrary example described herein in the section (Anti-FSTL1 antibody), etc. can be used as the antibody or the fragment or functional equivalent thereof for use in the treatment of metastatic malignant tumor of the present invention.

In this aspect, the present invention provides a method for treating or preventing metastatic malignant tumor or metastasis of malignant tumor, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

The disease targeted by the present invention is cancer. Examples thereof can include, but are not limited to, melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, and metastatic malignant tumor thereof. The cancer may be a cancer type highly expressing SNAIL and/or FSTL1. As for the expression of SNAIL and/or FSTL1, information obtained in the human tumor tissue analysis information site of Oncomine (see Table 1A in FIG. 126) provided by oncomine.com/resource/login.html explains that high expression is found in melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma. Therefore, it is understood that effects similar to those demonstrated in Examples are also produced for these cancer types.

(Oncomine Data)

In an alternative aspect, the present invention provides an inhibitor of metastasis of cancer cells, comprising the anti-FSTL1 antibody of the present invention or the fragment or functional equivalent thereof, and provides an inhibitor capable of inhibiting even bone metastasis, lung metastasis, liver metastasis, spleen metastasis, lymph node metastasis, or brain metastasis, particularly, bone metastasis or lung metastasis.

In this aspect, the present invention provides the anti-FSTL1 antibody of the present invention or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells. It is understood that an antibody of an arbitrary embodiment or arbitrary example described herein in the section (Anti-FSTL1 antibody), etc. can be used as the antibody or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells, according to the present invention.

In this aspect, the present invention provides a method for inhibiting metastasis (e.g., bone metastasis, lung metastasis, liver metastasis, spleen metastasis, lymph node metastasis, or brain metastasis) of cancer cells, particularly, for inhibiting bone metastasis or lung metastasis of cancer cells, comprising the step of administering an effective amount of the anti-FSTL1 antibody of the present invention or the fragment or functional equivalent thereof to a test subject in need thereof. Particularly, it has heretofore been considered that bone metastasis is very difficult to inhibit. Nonetheless, it has been found that this can be remarkably inhibited, as shown herein in Examples. In this respect as well, the superiority of the present invention is found. It is understood that an antibody of an arbitrary embodiment or arbitrary example described herein in the section (Anti-FSTL1 antibody), etc. can be used as the antibody or the fragment or functional equivalent thereof usable in the method of the present invention.

In a further alternative aspect, the present invention provides an inhibitor of induction or enhancement of immune defect such as immunosuppression or immunodeficiency by mesenchymal stem cells (MSCs), comprising the anti-FSTL1 antibody of the present invention or the fragment or functional equivalent thereof. The enhancement of immune defect such as immunosuppression or immunodeficiency includes at least one of growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity. The enhancement of immune defect such as immunosuppression or immunodeficiency by mesenchymal stem cells (MSCs) also conceptually encompasses induction of mesenchymal stem cells inducing immune defect such as immunosuppression or immunodeficiency. Such MSCs having high immunosuppressive ability are also known as activated MSCs or cancer-associated MSCs. Although not wishing to be bound by any theory, FSTL1 secreted from Snail-positive cancer cells or the like acts on so-called progenitor cells of MSCs so that the MSCs secrete an agent causing differentiation of progenitor cells of immunosuppressive cells into immunosuppressive immune-related cells (e.g., regulatory T cells, regulatory dendritic cells, tolerogenic dendritic cells, and myeloid-derived suppressor cells) and/or an agent promoting growth thereof, and/or an agent enhancing their immunosuppressive activity. As a result, the so-called progenitor cells become immunosuppressive cells, probably leading to an immunosuppressed state. Accordingly, the action of the anti-FSTL1 antibody as described in the invention of the present application probably suppresses the action of FSTL1 and consequently mitigate an immunosuppressed state.

Thus, in an alternative aspect, the present invention provides an inhibitor of acquirement and/or enhancement of activity of immune defect such as immunosuppression or immunodeficiency by or of immune-related cells, comprising the anti-FSTL1 antibody of the present invention or the fragment or functional equivalent thereof. The acquirement and/or enhancement of activity of immune defect such as immunosuppression or immunodeficiency by or of immune-related cells also includes the event of induction of immunosuppressive cells. Therefore, the inhibitor of acquirement and/or enhancement of activity of immune defect such as immunosuppression or immunodeficiency by or of immune-related cells conceptually includes an inhibitor of induction of cells having the activity of immune defect such as immunosuppression or immunodeficiency. It is understood that an antibody of an arbitrary embodiment or arbitrary example described herein in the section (Anti-FSTL1 antibody), etc. can be used as the antibody or the fragment or functional equivalent thereof usable in the method of the present invention.

In this aspect, the present invention provides the anti-FSTL1 antibody of the present invention or the fragment or functional equivalent thereof for the inhibition of acquirement and/or enhancement of activity of immune defect such as immunosuppression or immunodeficiency by or of immune-related cells. It is understood that an antibody of an arbitrary embodiment or arbitrary example described herein in the section (Anti-FSTL1 antibody), etc. can be used as the antibody or the fragment or functional equivalent thereof for the inhibition of acquirement and/or enhancement of activity of immune defect such as immunosuppression or immunodeficiency by or of immune-related cells according to the present invention.

In this aspect, the present invention provides a method for inhibiting acquirement and/or enhancement of immunosuppressive activity, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In one embodiment, the acquirement and/or enhancement of activity of immune defect such as immunosuppression or immunodeficiency for the inhibitor of the present invention includes at least 1, preferably at least 2, more preferably 3, more preferably 4, more preferably 5, more preferably 6, more preferably 7, more preferably 8, more preferably 9, more preferably 10, more preferably 11, more preferably all selected from the group consisting of growth of regulatory T cells, enhancement of the immunosuppressive activity of regulatory T cells, differentiation into regulatory T cells, enhancement of the immunosuppressive activity of regulatory dendritic cells, growth of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of (expansion of or differentiation into) exhausted T cells.

In a preferred embodiment, the present invention further includes a cell-killing agent in addition to the anti-FSTL1 antibody or the fragment or functional equivalent thereof, and a CTLA4 suppressor. Thus, the composition, the agent, the medicament, etc. (therapeutic drug or prophylactic drug, etc.) of the present invention may comprise a complex molecule or may be conjugated therewith.

In one aspect, the combination drug of the present invention may be combined with additional cancer treatment, in addition to a FSTL1 suppressor and a CTLA4 suppressor. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In the present specification, "cell-killing agent" is an agent likely to lyse cell membranes. In the case of a peptide, the cell-killing agent is called cytotoxic peptide. The cytotoxic peptide has various names in the art and is also referred to as, for example, "lytic peptide component", "cell-killing sequence", "cytolytic peptide (sequence)", or "cell membrane lytic peptide (sequence)". These terms are used interchangeably for the purpose of the present invention. Typical examples of such a cytotoxic agent can include those listed in Gail D. et al., Cancer Res 2008; 68: 9280-9290; Ian Krop and Eric P. Winer, Clin Cancer Res; 20 (1); 1-6; and K Naito et al., Leukemia (2000) 14, 1436-144, and can include maytansinoid, emtansine, and N-acetyl-γ-calicheamicin dimethylhydrazide (NAc-γ-calicheamicin, DMH) contained in CMA-676, though the cytotoxic agent is not limited thereto. As for the peptide, typical examples of the cell-killing peptide can include, but are not limited to, cell membrane lytic peptides, cell membrane potential-destabilizing peptides, cell membrane lytic/nucleic acid-binding peptides, and mitochondrial membrane-disrupting peptides.

If necessary, such a cell-killing agent may be bound to the binding agent (antibody, etc.) of the present invention via a spacer. In the present specification, "spacer" refers to a moiety that forms a chemical bond between chain polymer molecules so as to bridge the molecules, and is also called linker. Typical examples of the peptide spacer include, but are not limited to, a sequence of 0 to 5 amino acids consisting of G or P. The spacer is not essential and may be absent.

In the present invention, the combination of the anti-FSTL1 antibody and/or the antibody CTLA4 antibody, or fragment(s) or functional equivalent(s) thereof, and the cell-killing agent may be provided as a complex molecule. For exemplary explanation of such a molecule, the molecule can be interpreted as being formed by a cytotoxic moiety which corresponds to an explosive moiety and a moiety in charge of specificity for cancer cells which corresponds to a warhead moiety (e.g., a peptide or a sequence, typically an antibody, specifically binding to a receptor highly expressed in cancer cells) in combination. In the case of using a spacer, the complex molecule is constituted by cancer cell-specific binding agent+spacer+ cell-killing agent. In the present specification, an arbitrary cancer cell-specific binding agent, an arbitrary spacer, and an arbitrary cell-killing agent can be arbitrarily combined, and exemplary production and use methods thereof are described. Such a molecule may be produced usually by a chemical synthesis method or, when constituted by peptides, by a method of forcedly expressing the molecule by gene recombination, followed by purification, or a combined method thereof.

As for the use of the present invention, the expression of FSTL1 on the surface of cancer cells to be treated and the damage sensitivity of the cancer cells for the cell-killing agent are examined. On the basis of the results, the warhead and the explosive are selected, and a molecule optimal for the cancer cells is designed. The treatment can be performed by combining a custom-made peptide toxin obtained by chemical synthesis or the like, if necessary, with DDS containing atelocollagen or the like, followed by local administration or systemic administration.

The present invention has been found from working effects on Snail-positive cancer cells. Therefore, although not wishing to be bound by any theory, the target of the present invention can include cancer caused by Snail-positive cancer cells. Since some cancer cells cause EMT and express SNAIL, cells with "EMT" reportedly express SNAIL not only in such limited and several types of cancers but in really various cancer types. Examples of such cancer can include, but are not limited to, squamous cell cancer, melanoma, colorectal cancer, breast cancer, lymphoma, lung cancer, prostate cancer, kidney cancer, thyroid gland cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma.

An administration route effective for treatment is preferably used for the therapeutic drug and may be, for example, intravenous, subcutaneous, intramuscular, intraperitoneal, or oral administration. The dosage form may be, for example, an injection, a capsule, a tablet, or granules. In the case of administering the antibody or the polynucleotide, use as an injection is effective. An injectable aqueous solution may be preserved in, for example, a vial or a stainless container. Also, the injectable aqueous solution may be supplemented with, for example, saline, sugar (e.g., trehalose), NaCl, or NaOH. The therapeutic drug may be supplemented with, for example, a buffer (e.g., a phosphate buffer solution), a stabilizer, or a sustained-release agent such as an adjuvant.

In general, the composition, the medicament, the agent (therapeutic agent, prophylactic agent, etc.), etc. of the present invention comprises a therapeutically effective amount of the therapeutic agent or active ingredient, and a pharmaceutically acceptable carrier or excipient. In the present specification, the phrase "pharmaceutically acceptable" means that for use in animals, more specifically, humans, the material has been approved by government's regulatory authorities or is pharmacopeial or is listed in other generally accepted pharmacopoeia. "Carrier" used herein refers to a diluent, an adjuvant, an excipient, or a vehicle that is administered together with the therapeutic agent. Such a carrier may be a sterile liquid, for example, water or oil. The carrier includes those of petroleum, animal, plant, or synthetic origin and includes, but is not limited to, peanut oil, soybean oil, mineral oil, and sesame oil. In the case of orally administering the medicament, water is a preferred carrier. In the case of intravenously administering the pharmaceutical composition, saline or aqueous dextrose is a preferred carrier. Preferably, a saline solution or an aqueous dextrose or glycerol solution is used as a liquid carrier for an injectable solution. An appropriate excipient includes light anhydrous silicic acid, crystalline cellulose, mannitol, starch, glucose, lactose, sucrose, gelatin, malt, rice, wheat flour, chalk, silica gel, sodium stearate, glycerol monostearate, talc, sodium chloride, powdered skim milk, glycerol, propylene, glycol, water, ethanol, carmellose calcium, carmellose sodium, hydroxypropylcellulose, hydroxypropylmethylcellulose, polyvinyl acetal diethylaminoacetate, polyvinylpyrrolidone, gelatin, medium-chain fatty acid triglyceride, polyoxyethylene hydrogenated castor oil 60, saccharose, carboxymethylcellulose, corn starch, inorganic salts, and the like. If desired, the composition may also contain a small amount of a wetting agent or emulsifying agent, or a pH buffering agent. Such a composition may assume the form of a solution, a suspension, an emulsion, a tablet, a pill, a capsule, a powder, a sustained-release formulation, or the like. The composition may be formulated as a suppository using a traditional binder and carrier, for example, triglyceride. An oral formulation may contain a standard carrier such as a pharmaceutical grade of mannitol, lactose, starch, magnesium stearate, saccharin sodium, cellulose, or magnesium carbonate. Examples of an appropriate carrier are described in E. W. Martin, Remington's Pharmaceutical Sciences (Mark Publishing Company, Easton, U.S.A). Such a composition contains a therapeutically effective amount of a therapeutic agent, preferably a purified form, together with an appropriate amount of the carrier, so as to provide a dosage form appropriate for a patient. The formulation must be suitable for the mode of administration. In addition, for example, a surfactant, an excipient, a colorant, a flavor, a preservative, a stabilizer, a buffer, a suspending agent, a tonicity agent, a binder, a disintegrant, a lubricant, a flowability-promoting agent, and a corrigent may be contained therein.

In the case of administering the medicament of the present invention, various delivery systems are known, and the therapeutic agent of the present invention may be administered to an appropriate site (e.g., the esophagus) using such a system. Such a system includes, for example: encapsulation in liposomes, microparticles, and microcapsules; use of recombinant cells capable of expressing the therapeutic agent (e.g., polypeptide); and use of endocytosis mediated by a receptor. An introduction method is not limited and includes, intracutaneous, intramuscular, intraperitoneal, intravenous, subcutaneous, intranasal, epidural, and oral routes. The medicament may be administered through any suitable route, for example, by injection, by bolus injection, or by absorption through epithelial or mucocutaneous linings (e.g., the mouth, the rectus, and intestinal mucosa). If necessary, an inhalator or an atomizer may be used by use of an aerosol agent. Furthermore, the medicament may be administered together with another biologically active agent. The administration may be systemic or local. The present invention also permits direct administration to tumor.

In a preferred embodiment, the composition can be formulated as a pharmaceutical composition adapted to administration to humans according to a publicly known method. Such a composition can be administered by injection. Typically, the composition for administration by injection is a solution in a sterile isotonic aqueous buffer. If necessary, the composition may also contain a solubilizing agent and a local anesthetic, such as lidocaine, which lessens pain at an injection site. In general, ingredients are separately supplied or mixed and supplied together in a unit dosage form, and can be supplied, for example, as a freeze-dried powder or a water-free concentrate in a sealed container, such as an ampule or a sachet, which indicates the amount of the active agent. In the case of administering the composition by injection, the composition may be dispensed using injection bottles containing a sterile drug grade of water or saline. In the case of administering the composition by injection, an ampule with sterile water or saline for injection may be provided such that ingredients can be mixed before the administration.

The antibody, etc. the composition, the medicament, the agent (therapeutic agent, prophylactic agent, etc.), etc. of the present invention may be formulated in a neutral or salt form or as any other prodrug (e.g., ester). A pharmaceutically acceptable salt includes a salt formed with a free carboxyl group derived from hydrochloric acid, phosphoric acid, acetic acid, oxalic acid, tartaric acid, or the like, a salt formed with a free amine group derived from isopropylamine, triethylamine, 2-ethylaminoethanol, histidine, procaine, or the like, and a salt derived from sodium, potassium, ammonium, calcium, ferric hydroxide, or the like.

The amount of the therapeutic agent of the present invention effective for the treatment of a particular disorder or condition may vary depending on the properties of the disorder or the condition and can be determined by those skilled in the art according to a standard clinical technique on the basis of the description of the present specification. In some cases, use of in vitro assay may assist in the identification of the optimum dosage range. An accurate dose to be used in a formulation may also vary depending on an administration route and the severity of a disease or a disorder and should therefore be determined according to the judgment of a doctor in attendance and the situation of each patient. However, the dose may be, but is not particularly limited to, for example, 0.001, 1, 5, 10, 15, 100, or 1000 mg/kg body weight in one dose, or may be within the range of any two of these values. The dosing interval may be, but is not particularly limited to, for example, once or twice per 1, 7, 14, 21, or 28 days, or may be once or twice per the range of any two of these values. The dose, the dosing interval, and the administration method may be appropriately selected according to the age and body weight of a patient, symptoms, a target organ, etc. The therapeutic drug preferably comprises the active ingredient in a therapeutically effective amount, or an effective amount that exerts the desired action. In the case where a malignant tumor marker is significantly reduced after administration, the therapeutic drug may be judged as having therapeutic effects. The effective dose is predictable from a dose-response curve obtained from an in vitro or animal model test system.

In one embodiment of the present invention, "patient" includes a human or a non-human mammal (e.g., one or more of a mouse, a guinea pig, a hamster, a rat, a rodent, a rabbit, a pig, sheep, a goat, cattle, a horse, a cat, a dog, a marmoset, a monkey, a chimpanzee, and the like). Also, the patient may be a patient judged or diagnosed as having FSTL1- or Snail-positive malignant tumor. In this respect, it is preferred to conduct the judgment or diagnosis by detecting the protein level of FSTL1 or Snail.

The pharmaceutical composition or the agent (therapeutic agent, prophylactic agent, etc.) of the present invention can be provided as a kit. In a particular embodiment, the present invention provides a drug pack or kit comprising one or more containers packed with one or more ingredients of the composition or the medicament of the present invention. In some cases, information indicating governmental agency's approval for production, use, or distribution for administration to humans in a form specified by the governmental agency that regulates the production, use, or distribution of medicaments or biological products may be shown with such containers.

The kit of the present invention may also contain an expression vector encoding a protein that is used as the antibody, etc., the composition, the therapeutic agent, the prophylactic agent, or the medicament of the present invention. This protein forms a biologically active complex after being expressed, and may therefore be reconstituted. Such a kit also preferably contains a necessary buffer and reagent. In some cases, an instruction manual (package insert) for use of the kit, and/or information indicating governmental agency's approval for production, use, or distribution for administration to humans in a form specified by the governmental agency that regulates the production, use, or distribution of medicaments or biological products may be shown with such containers.

(Combination Drug)

In one aspect, the present invention provides a combination product of a FSTL1 suppressor and a CTLA4 suppressor. Although not wishing to be bound by any theory, the present invention is based on the unexpectedly remarkable enhancement of an immunosuppression-mitigating effect on cancer as illustrated in Examples showing such a remarkable effect that colorectal cancer disappeared by suppressing the pathway of FSTL1 and also suppressing the pathway of CTLA4, and the survival rate was 100% within the examined range. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted. The FSTL1 suppressor and the CTLA4 suppressor that can be used in the present invention may be in any form including those listed above, etc. as long as these suppressors can suppress the signaling pathway of FSTL1 and the signaling pathway of CTLA4, respectively. In a preferred embodiment, in the combination product of the present invention, the FSTL1 suppressor is an anti-FSTL1 antibody or a fragment or functional equivalent thereof, and/or the CTLA4 suppressor is an anti-CTLA4 antibody or a fragment or functional equivalent thereof.

In one aspect, the present invention provides a combination product of an anti-FSTL1 antibody or a fragment or functional equivalent thereof and an anti-CTLA4 antibody or a fragment or functional equivalent thereof.

In one embodiment, the anti-FSTL1 antibody used in the present invention recognizes an epitope in a region selected from the group consisting of amino acid positions 48 to 100, 148 to 170 (preferably 148 to 162), 193 to 228 or 193 to 216, 205 to 228, and 272 to 289 of SEQ ID NO: 503 (amino acid sequence of human FSTL1).

In a preferred embodiment, the anti-FSTL1 antibody used in the present invention comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570).

In a more preferred embodiment, the anti-FSTL1 antibody used in the present invention comprises the full-length variable regions of an antibody selected from the group consisting of antibody #6-55 (light chain: SEQ ID NO: 528; heavy chain: SEQ ID NO: 530), #7-34 (light chain: SEQ ID NO: 532; heavy chain: SEQ ID NO: 534), #8-1 (light chain: SEQ ID NO: 536; heavy chain: SEQ ID NO: 538), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570).

In a further alternative embodiment, the anti-FSTL1 antibody used in the present invention comprises a full-length antibody selected from the group consisting of antibody #6-55 (light chain: SEQ ID NO: 618; heavy chain: SEQ ID NO: 620), #7-34 (light chain: SEQ ID NO: 622; heavy chain: SEQ ID NO: 624), #8-1 (light chain: SEQ ID NO: 626; heavy chain: SEQ ID NO: 628), #7 (light chain: SEQ ID NO: 642; heavy chain: SEQ ID NO: 644), #10 (light chain: SEQ ID NO: 656; heavy chain: SEQ ID NO: 658), #13 (light chain: SEQ ID NO: 650; heavy chain: SEQ ID NO: 652) and #33 (light chain: SEQ ID NO: 658; heavy chain: SEQ ID NO: 660) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 528; heavy chain: SEQ ID NO: 530), #7 (light chain: SEQ ID NO: 552; heavy chain: SEQ ID NO: 554), #10 (light chain: SEQ ID NO: 556; heavy chain: SEQ ID NO: 558), #13 (light chain: SEQ ID NO: 560; heavy chain: SEQ ID NO: 562) and #33 (light chain: SEQ ID NO: 568; heavy chain: SEQ ID NO: 570) or a humanized sequence thereof.

In one embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 671, 673, 675, and 677, respectively) and L chain FR1, FR2, FR3, and FR4 (SEQ ID NOs: 687, 689, 691, and 693, respectively) of H(2)-L(1).

In one embodiment, the anti-CTLA4 antibody has the ability to inhibit the binding between CTLA4 and CD80 and/or CD86 (see e.g., http://first.lifesciencedb.jp/archives/1194).

In one embodiment, the anti-CTLA4 antibody used in the present invention recognizes an epitope similar to an epitope for clone 9H10 (BioLegend, Inc.) or ipilimumab (the amino acid sequence of its heavy chain is represented by SEQ ID NO: 756, and the amino acid sequence of its light chain is represented by SEQ ID NO: 757).

In an alternative embodiment, the anti-CTLA4 antibody used in the present invention comprises the heavy chain CDR1, heavy chain CDR2, heavy chain CDR3, light chain CDR1, light chain CDR2, and light chain CDR3 of antibody clone 9H10 (BioLegend, Inc.) or ipilimumab. As for the CDR sequences of ipilimumab, the heavy chain CDR1 is SYTMH (positions 31 to 35 of SEQ ID NO: 756), the heavy chain CDR2 is FISYDGNNKYYADSVKG (positions 50 to 66 of SEQ ID NO: 756), the heavy chain CDR3 is TGWLGPFDY (positions 99 to 107 of SEQ ID NO: 756), the light chain CDR1 is RASQSVGSSYLA (positions 24 to 35 of SEQ ID NO: 757), the light chain CDR2 is GAFSRAT (positions 51 to 57 of SEQ ID NO: 757), and the light chain CDR3 is QQYGSPWT (positions 90 to 97 of SEQ ID NO: 757). Since ipilimumab recognizes an epitope in a binding site of CTLA4 to its ligands B7.1 and B7.2, such epitope characteristics can be preferred.

In an alternative embodiment, the anti-CTLA4 antibody used in the present invention comprises full-length variable regions (positions 1 to 118 of the heavy chain (SEQ ID NO: 756) and positions 1 to 110 of the light chain (SEQ ID NO: 757)) of antibody clone 9H10 (BioLegend, Inc.) or ipilimumab.

In an alternative embodiment, the anti-CTLA4 antibody used in the present invention comprises full-length (SEQ ID NO: 756 and SEQ ID NO: 757) antibody clone 9H10 (BioLegend, Inc.) or ipilimumab, or a humanized sequence thereof.

In an alternative aspect, the present invention provides a medicament comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the medicament of the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides an anticancer agent comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides a therapeutic agent for metastatic malignant tumor comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for metastatic malignant tumor of the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides a therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for these diseases of the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides an inhibitor of metastasis (e.g., bone metastasis or lung metastasis) of cancer cells, comprising the combination product of the present invention and provides an inhibitor capable of inhibiting even bone metastasis, lung metastasis, liver metastasis, spleen metastasis, lymph node metastasis, or brain metastasis, particularly, bone metastasis or lung metastasis. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of metastasis of cancer cells of the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides an inhibitor of induction or enhancement of immune defect such as immunosuppression or immunodeficiency by mesenchymal stem cells (MSCs), comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of induction or enhancement of immune defect such as immunosuppression or immunodeficiency by MSCs according to the present invention. It is understood that an antibody of an arbitrary embodiment or arbitrary example described herein can be used as the anti-CTLA4 antibody or the fragment or functional equivalent thereof in the medicament of the present invention.

In a further alternative aspect, the present invention provides an inhibitor of acquirement and/or enhancement of activity of immune defect such as immunosuppression or immunodeficiency by or of immune-related cells, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of acquirement and/or enhancement of activity of immune defect such as immunosuppression or immunodeficiency by or of immune-related cells according to the present invention. It is understood that an antibody of an arbitrary embodiment or arbitrary example described herein can be used as the anti-CTLA4 antibody or the fragment or functional equivalent thereof in the medicament of the present invention.

In one embodiment, the acquirement and/or enhancement of immune defect activity by or of immune-related cells includes at least 1, preferably at least 2, more preferably at least 3, more preferably at least 4, more preferably at least 5, more preferably at least 6, more preferably at least 7, more preferably at least 8, more preferably at least 9, more preferably at least 10, more preferably at least 11, more preferably at least 12, more preferably at least 13, more preferably at least 14, more preferably all selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

In one aspect, the medicament, the anticancer agent, the therapeutic agent, or the inhibitor of the present invention may be combined with additional cancer treatment. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In an alternative aspect, the present invention provides an anticancer agent comprising a FSTL1 suppressor, wherein the FSTL1 suppressor is administered in combination with a CTLA4 suppressor. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. The FSTL1 suppressor and the CTLA4 suppressor that can be used in the present invention may be in any form including those listed above, etc. as long as these suppressors can suppress the signaling pathway of FSTL1 and the signaling pathway of CTLA4, respectively. In a preferred embodiment, in the anticancer agent of the present invention, the FSTL1 suppressor is an anti-FSTL1 antibody or a fragment or functional equivalent thereof, and/or the CTLA4 suppressor is an anti-CTLA4 antibody or a fragment or functional equivalent thereof.

Preferably, the present invention provides an anticancer agent comprising an anti-FSTL1 antibody or a fragment or functional equivalent thereof, wherein the anti-FSTL1 antibody or the fragment or functional equivalent thereof is administered in combination with an anti-CTLA4 antibody or a fragment or functional equivalent thereof. The type of usage of such an anticancer agent, which comprises the anti-FSTL1 antibody or the fragment or functional equivalent thereof, is combined use, and such combined use is described, for example, in a kit or in a package insert. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the anti-FSTL1 antibody or the fragment or functional equivalent thereof. It is understood that an antibody of an arbitrary embodiment or arbitrary example described herein can be used as the anti-CTLA4 antibody or the fragment or functional equivalent thereof in the medicament of the present invention.

In an alternative aspect, the present invention provides an anticancer agent comprising a CTLA4 suppressor, wherein the CTLA4 suppressor is administered in combination with a FSTL suppressor. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. The FSTL1 suppressor and the CTLA4 suppressor that can be used in the present invention may be in any form including those listed above, etc. as long as these suppressors can suppress the signaling pathway of FSTL1 and the signaling pathway of CTLA4, respectively. In a preferred embodiment, in the anticancer agent of the present invention, the FSTL1 suppressor is an anti-FSTL1 antibody or a fragment or functional equivalent thereof, and/or the CTLA4 suppressor is an anti-CTLA4 antibody or a fragment or functional equivalent thereof.

Preferably, the present invention provides an anticancer agent comprising an anti-CTLA4 antibody or a fragment or functional equivalent thereof, wherein the anti-CTLA4 antibody or the fragment or functional equivalent thereof is administered in combination with an anti-FSTL1 antibody or a fragment or functional equivalent thereof. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the anti-CTLA4 antibody or the fragment or functional equivalent thereof. It is understood that an antibody of an arbitrary embodiment or arbitrary example described herein can be used as the anti-CTLA4 antibody or the fragment or functional equivalent thereof in the medicament of the present invention.

In one aspect, the present invention provides a method for treating or preventing cancer, comprising the step of administering an effective amount of a FSTL1 suppressor and an effective amount of a CTLA4 suppressor in combination. Although not wishing to be bound by any theory, the method of the present invention is based on the unexpectedly remarkable enhancement of an immunosuppression-mitigating effect on cancer as illustrated in Examples showing such a remarkable effect that colorectal cancer disappeared by suppressing the pathway of FSTL1 and also suppressing the pathway of CTLA4. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted. The FSTL1 suppressor and the CTLA4 suppressor that can be used in the present invention may be in any form including those listed above, etc. as long as these suppressors can suppress the signaling pathway of FSTL1 and the signaling pathway of CTLA4, respectively. In a preferred embodiment, in the method of the present invention, the FSTL1 suppressor is an anti-FSTL1 antibody or a fragment or functional equivalent thereof, and/or the CTLA4 suppressor is an anti-CTLA4 antibody or a fragment or functional equivalent thereof.

Preferably, the present invention provides a method for treating or preventing cancer, comprising the step of administering an effective amount of an anti-FSTL1 antibody or a fragment or functional equivalent thereof and an effective amount of an anti-CTLA4 antibody or a fragment or functional equivalent thereof in combination to a test subject in need thereof. The anti-FSTL1 antibody or the fragment or functional equivalent thereof and the anti-CTLA4 antibody or the fragment or functional equivalent thereof may be administered at the same time or may be administered separately (at different times). The anti-FSTL1 antibody or the fragment or functional equivalent thereof and the anti-CTLA4 antibody or the fragment or functional equivalent thereof may be prepared as a combination formulation or may be administered as separate dosage forms. The anti-FSTL1 antibody or the fragment or functional equivalent thereof and the anti-CTLA4 antibody or the fragment or functional equivalent thereof may be administered through the same route or may be administered through different routes (e.g., oral and intravenous routes).

(General Technique)

Molecular biological approaches, biochemical approaches, and microbial approaches used herein are well known in the art and conventionally used. These approaches are described in, for example, Sambrook J. et al. (1989). Molecular Cloning: A Laboratory Manual, Cold Spring Harbor and Id., 3rd Ed. (2001); Ausubel, F. M. (1987). Current Protocols in Molecular Biology, Greene Pub. Associates and Wiley-Interscience; Ausubel, F. M. (1989). Short Protocols in Molecular Biology: A Compendium of Methods from Current Protocols in Molecular Biology, Greene Pub. Associates and Wiley-Interscience; Innis, M. A. (1990). PCR Protocols: A Guide to Methods and Applications, Academic Press; Ausubel, F. M. (1992). Short Protocols in Molecular Biology: A Compendium of Methods from Current Protocols in Molecular Biology, Greene Pub. Associates; Ausubel, F. M. (1995). Short Protocols in Molecular Biology: A Compendium of Methods from Current Protocols in Molecular Biology, Greene Pub. Associates; Innis, M. A. et al. (1995). PCR Strategies, Academic Press; Ausubel, F. M. (1999). Short Protocols in Molecular Biology: A Compendium of Methods from Current Protocols in Molecular Biology, Wiley, and annual updates; Sninsky, J. J. et al. (1999). PCR Applications: Protocols for Functional Genomics, Academic Press, and Experimental Medicine, Suppl. "Experimental Methods for Gene Transfer & Expression Analysis", Yodosha Co., Ltd., 1997, the related parts (which may be the entire parts) of which are incorporated herein by reference.

DNA synthesis techniques and nucleic acid chemistry for preparing artificially synthesized genes are described in, for example, Gait, M. J. (1985). Oligonucleotide Synthesis: A Practical Approach, IRL Press; Gait, M. J. (1990). Oligonucleotide Synthesis: A Practical Approach, IRL Press; Eckstein, F. (1991). Oligonucleotides and Analogues: A Practical Approach, IRL Press; Adams, R. L. et al. (1992). The Biochemistry of the Nucleic Acids, Chapman & Hall; Shabarova, Z. et al. (1994). Advanced Organic Chemistry of Nucleic Acids, Weinheim; Blackburn, G. M. et al. (1996). Nucleic Acids in Chemistry and Biology, Oxford University Press; Hermanson, G. T. (1996). Bioconjugate Techniques, Academic Press, the related parts of which are incorporated herein by reference.

In the present specification, the oligonucleotide of the present invention may be synthesized, for example, by a standard method known in the art using, for example, an automatic DNA synthesis apparatus (e.g., commercially available from Biosearch Technologies, Inc., Applied Biosystems, Inc., etc.). For example, phosphorothioate oligonucleotide may be synthesized by the method of Stein et al. (Stein et al., 1988, Nucl. Acids Res. 16: 3209), and methylphosphonate oligonucleotide may be prepared by use of a controlled pore glass polymer support (Sarin et al., 1988, Proc. Natl. Acad. Sci. USA 85: 7448-7451) or the like.

In the present specification, the term "or" is used when "at least one or more" of the items listed in a sentence can be adopted. In the present specification, the phrase "within the range of two values" means that the range also includes the two values themselves.

References such as scientific literatures, patents, and patent applications cited herein are incorporated herein by reference in their entirety to the same extent as respectively described specifically.

The present invention is described above by showing preferred embodiments in order to facilitate understanding. Hereinafter, the present invention will be described with reference to Examples. However, the description mentioned above and Examples given below are provided merely for illustrative purposes and are not intended to limit the present invention. Thus, the scope of the present invention is limited by neither the embodiments nor Examples specifically described herein and is limited only by claims.

EXAMPLES

Hereinafter, the present invention will be further described with reference to Examples. However, the present invention is not intended to be limited by these examples.

<Example 1> Preparation of Anti-FSTL1 Antibody

Three 3-month-old Boris Brown chickens were intraperitoneally immunized with 100 µg of an antigen human FSTL1 (Novoprotein, Cat # CF23) (SEQ ID NO: 661) per shot per chicken. A complete Freund's adjuvant (Wako Pure Chemical Industries, Ltd., 014-09541) for primary immunization and an incomplete Freund's adjuvant (Wako Pure Chemical Industries, Ltd., 011-09551) for secondary, tertiary, and quaternary immunization were used in the intraperitoneal immunization with the antigen. For quinary immunization, the antigen diluted with PBS (phosphate buffered saline) was intravenously injected thereto. Blood was collected from the veins under the wings every other week, and antibody titers were confirmed by ELISA. The quaternary immunization was carried out for the three chickens, and one individual found to have the largest rise in antibody titer was subjected to quinary immunization, which was used as final immunization. Three days after final immunization, the spleen of the chicken was recovered, and lymphocytes were isolated by density gradient centrifugation using Ficoll paque PLUS (GE Healthcare Japan Corp., 17-1440-03), followed by RNA extraction using TRIzole Reagent (Life Technologies Corp., 15596026). cDNA was synthesized from the extracted RNA by RT-PCR using PrimeScript II 1st Strand cDNA Synthesis Kit (Takara Bio Inc., 6210A), and scFv phage libraries were prepared. The expression vector used was pPDS. The preparation of the scFv phage libraries was performed by the method described in the reference "Nakamura et al., J Vet Med Sci. 2004 Ju; 66 (7): 807-814".

FSTL1-specific phages were enriched by panning using the scFv phage libraries. The antigen used in the panning was human FSTL1 (Novoprotein, Cat # CF23) alone or two antigens for panning, human FSTL1 (R&D Systems, Inc., Cat #1694-FN-050) and mouse FSTL1 (R&D Systems, Inc., Cat #1738-FN-050), alternately used. Antibodies also having cross reactivity with mice were thereby obtained. The panning was performed according to the method described in the reference "Nakamura et al., J Vet Med Sci. 2004 Ju; 66 (7): 807-814". After the 5th round of panning, the reactivity of the libraries was confirmed by ELISA using human FSTL1- and mouse FSTL1-immobilized plates, and phage screening was conducted from a library whose reactivity started to rise. For scFv phage antibody sample preparation, E. coli was infected with a phage and plated over 2×YT Agar plate containing ampicillin (50 µg/ml, Nacalai Tesque, Inc., 02739-32), and the obtained colonies were cultured in a 2×YT liquid medium containing ampicillin. After infection with a helper phage, phage induction was performed in 2×YT liquid medium containing ampicillin (50 µg/ml), kanamycin (25 µg/ml, Meiji Seika Pharma Co., Ltd., GS1-RSS), and IPTG (100 µg/ml, Nacalai Tesque, Inc., 19742-94). The reactivity of scFv phage antibodies in the obtained culture supernatants was confirmed by ELISA using antigen-immobilized plates.

In screening by ELISA, 1 µg/ml of human FSTL1 or mouse FSTL1 diluted with PBS was placed at 50 µl/well to a 96-well plate (Nalge Nunc International, Cat. No. 442404), and the antigen was immobilized overnight at 4° C. After the immobilization, the wells were blocked with PBS containing 25% Block Ace (DS Pharma Biomedical Co., Ltd, UK-B80) and reacted with the culture supernatants containing the scFv phage antibodies. A solution of HRP-labeled Goat anti-mouse IgG (H+L) (Kirkegaard & Perry Laboratories, Inc. (KPL), Cat. No. 474-1806) diluted 1000-fold with 10% Block Ace was added as a secondary antibody, and the color development of OPD used as a substrate was measured as absorbance at 490 nm and 630 nm using a plate leader (Bio-Rad Laboratories, Inc., Model 680). These conditions are summarized in Table 1.

TABLE 3-1

| 1 Immobilized antigen: | 50 µL/well | O/N, 4° C. | 1 µg/mL human or mouse FSTL1 |
|---|---|---|---|
| 2 Blocking: | 250 µL/well | 60 min, 37° C. | 25% Block Ace/PBS |
| 3 Primary antibody: | 50 µL/well | 60 min, 37° C. | scFv phage antibody-containing culture supernatant |

TABLE 3-1-continued

| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 nm | | |

(O/N means overnight.)

The DNA sequencing of the positive clones obtained by ELISA was outsourced to Eurofins Genomics K. K. to determine the sequences.

As for clones differing in sequence, chicken-derived antibody H chain variable region and L chain variable region genes were amplified by PCR with a scFv antibody-encoding DNA strand as a template. Then, the PCR products were digested with restriction enzymes SacII (New England BioLabs Japan Inc., Cat # R0157S) and NheI (New England BioLabs Japan Inc., Cat # R0131S). Next, the H chain variable region and L chain variable region genes were respectively recombined into mouse/chicken chimeric antibody (IgG1) expression vectors (expression vector for H chain: pcDNA4/myc-His, expression vector for L chain: pcDNA3/myc-His, Invitrogen Corp.) treated with the same restriction enzymes as above. CHO cells were transfected with the prepared H chain and L chain constructs. Then, the reactivity of culture supernatants was confirmed by ELISA using a human or mouse FSTL1 protein-immobilized solid phase. The mouse chimeric expression vector used was the vector described in Tateishi et al., J Vet Med Sci. 2008 April; 70 (4): 397-400.

Among the antibody clones (chicken-mouse chimeric antibodies) thus obtained, clone #5-2, #5-3, #5-8, #5-10, #5-43, #6-55, #7-34, #8-1, #8-4, #8-7, #8-8, #6-55, #7, #10, #13, #22, and #33 were used in experiments given below. The amino acid sequences of the light chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 508, 512, 516, 520, 524, 528, 532, 536, 540, 544, 548, 552, 556, 560, 564, and 568, respectively. The full-length amino acid sequences of the light chains thereof are represented by SEQ ID NOs: 598, 602, 606, 610, 614, 618, 622, 626, 630, 634, 638, 642, 646, 650, 654, and 658, respectively. The nucleic acid sequences of the light chain variable regions thereof are represented by SEQ ID NOs: 507, 511, 515, 519, 523, 527, 531, 535, 539, 543, 547, 551, 555, 559, 563, and 567, respectively. The full-length nucleic acid sequences of the light chains thereof are represented by SEQ ID NOs: 597, 601, 605, 609, 613, 617, 621, 625, 629, 633, 637, 641, 645, 649, 653, and 657, respectively. The amino acid sequences of the heavy chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 510, 514, 518, 522, 526, 530, 534, 538, 542, 546, 550, 554, 558, 562, 566, and 570, respectively. The full-length amino acid sequences of the heavy chains thereof are represented by SEQ ID NOs: 600, 604, 608, 612, 616, 620, 624, 628, 632, 636, 640, 644, 648, 652, 656, and 660, respectively. The nucleic acid sequences of the heavy chain variable regions thereof are represented by SEQ ID NOs: 509, 513, 517, 521, 525, 529, 533, 537, 541, 545, 549, 553, 557, 561, 565, and 569, respectively. The full-length nucleic acid sequences of the heavy chains thereof are represented by SEQ ID NOs: 599, 603, 607, 611, 615, 619, 623, 627, 631, 635, 639, 643, 647, 651, 655, and 659, respectively.

For the large-scale production of the antibody clones described above, cultured mammalian cells were transfected with the prepared H chain and L chain constructs using Expi293 Expression system (Invitrogen Corp., Cat # A14635). Then, the expressed antibodies were purified using Protein G Sepharose 4 Fast Flow (GE Healthcare Japan Corp., 17-018-02). The measurement of the binding activity of the obtained purified antibody of each clone against FSTL1 will be shown in Example 2.

<Example 2> Evaluation of Binding Activity of Purified Antibody Against FSTL1

The reactivity of the obtained antibody clones described above with FSTL1 was evaluated by ELISA under the following conditions.

(Table 2 ELISA Conditions for Binding Activity Evaluation of Purified Antibody)
Antibodies used: anti-dinitrophenyl (DNP) antibody (negative control), #5-2, #5-3, #5-8, #5-10, #5-43, #6-55, and #7-34

TABLE 3-2

| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |
| 3 Primary antibody: | 50 µL/well | 60 min, 37° C. | Each antibody serially diluted 2-fold from 1 µg/mL/10% Block Ace |
| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 nm | | |

O/N means overnight.

Figure 63:
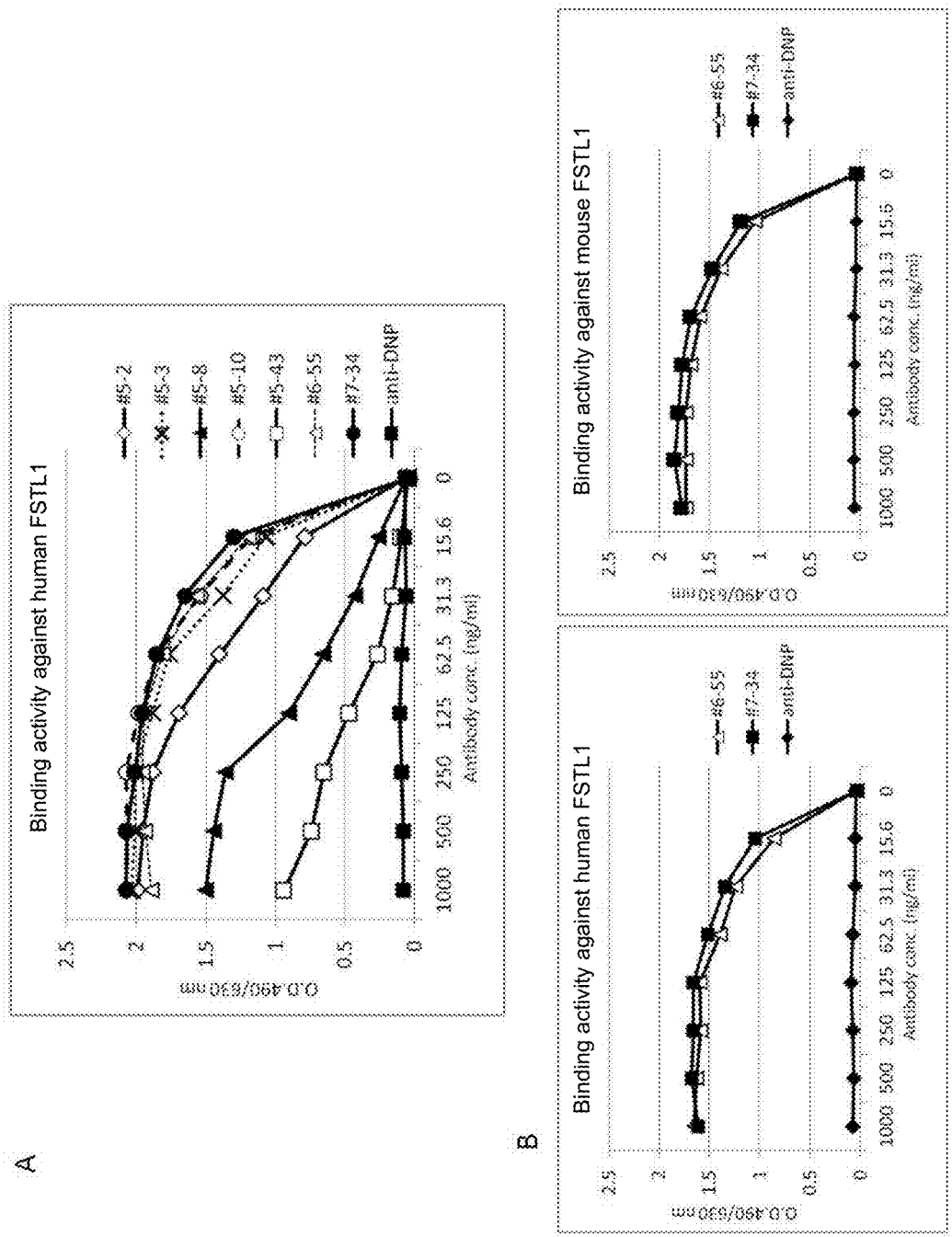
FIG. 63 is graphs showing the binding activity of the antibody of the present invention against FSTL1 (Example 2). Part A shows results of evaluating the binding activity of clones obtained by initial screening against human FSTL1 by ELISA. The open rhomboid depicts clone #5-2, the cross mark depicts clone #5-4, the filled triangle depicts clone #5-8, the open circle depicts clone #5-10, the open square depicts clone #5-43, the open triangle depicts clone #6-55, the filled circle depicts clone #7-34, and the filled square depicts a control anti-dinitrophenyl (DNP) antibody. The strength of the binding activity was #5-10, #6-55, and #7-34>#5-3>#5-8>#5-43. Part B shows results of examining the cross reactivity between mice and humans. Among the antibodies shown in Part A, clones that also exhibited reactivity with mouse FSTL1 in the screening were evaluated for their binding activity. The binding activity against human FSTL1 is shown on the left, and the binding activity against mouse FSTL1 is shown on the right. Both #6-55 and #7-34 exhibited strong binding activity against human and mouse FSTL1.

As a result, binding activity specific for human FSTL1 was confirmed. The strength of the binding activity was compared and was consequently #6-55, #7-34, and #5-10>#5-3>#5-8>#5-43 (FIG. 63A). Among the antibody clones, #6-55 and #7-34 exhibited specific and equivalently strong binding activity against both human and mouse FSTL1 (FIG. 63B).

Figure 64:
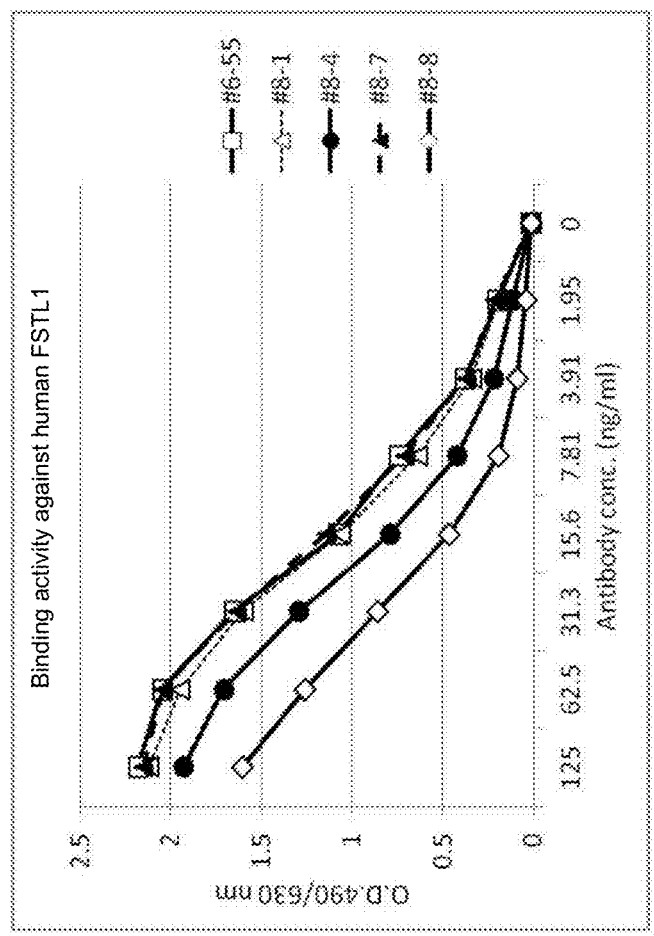
FIG. 64 shows results of evaluating the binding activity of clones obtained by middle screening against human FSTL1 by ELISA (Example 2). The open square depicts clone #6-55, the open triangle depicts clone #8-1, the filled circle depicts clone #8-4, the filled triangle depicts clone #8-7, and the open rhomboid depicts clone #8-8. The assay was conducted together with #6-55 for comparison. The strength of the binding activity was clone #6-55, #8-1, and #8-7>#8-4>#8-8. *The antibody concentration in FIG. 64 was diluted from 125 ng/ml.
Figure 65:
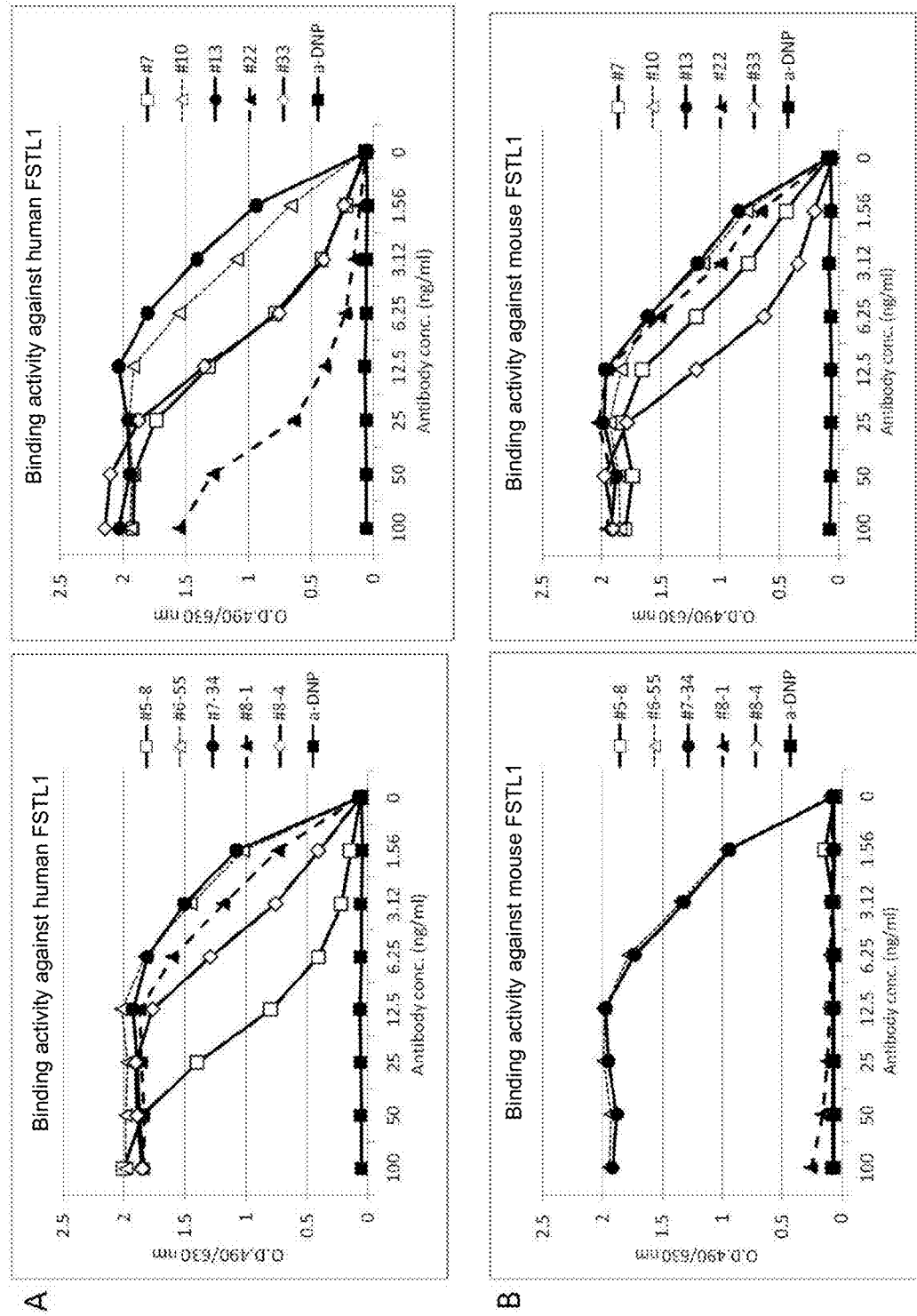
FIG. 65 is graphs showing the binding activity of clones obtained by panning using mouse FSTL1 (Example 2). The right and left graphs of Part A or the right and left graphs of Part B show results that were obtained by evaluation at the same time but were indicated by two divided graphs for the sake of the visibility of the figure due to a large number of clones. Part A shows results of evaluating the binding activity of clones also including clones (#7, #10, #13, #22, and #33) obtained by panning using mouse FSTL1 against human FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against human FSTL1 was #6-55, #7-34, and #13>#8-1 and #10>#8-4>#7 and #33>#5-8>#22. The binding activity of the anti-DNP antibody was not observed. Part B shows results of evaluating the binding activity of the same clones as above against mouse FSTL1 by ELISA. In the left graph, the open square depicts clone #5-8, the open triangle depicts clone #6-55, the filled circle depicts clone #7-34, the filled triangle depicts clone #8-1, the open rhomboid depicts clone #8-4, and the filled square depicts an anti-DNP antibody. In the right graph, the open square depicts clone #7, the open triangle depicts clone #10, the filled circle depicts clone #13, the filled triangle depicts clone #22, the open rhomboid depicts clone #33, and the filled square depicts an anti-DNP antibody. The strength of the binding activity against mouse FSTL1 was #6-55, #7-34, #10, and #13>#22>#7>#33>#8-1. #8-1 slightly exhibited binding activity. #5-8, #8-4, and the anti-DNP antibody exhibited no binding activity. The antibody concentration in FIG. 65 was diluted from 100 ng/ml. On the basis of these ELISA results of binding activity and in vitro evaluation, promising clones to be subjected to in vivo evaluation were narrowed down (#6-55, #7-34, and #8-1). Clones newly obtained by panning (#7, #10, #13, #22, and #33) were further used as subjects in the in vivo evaluation.

FIGS. 64 and 65 show results of evaluating binding activity under the condition of Table 3 as to clones differing in screening and antibody purification timings.

(Table 3 ELISA Conditions for Binding Activity Evaluation of Purified Antibody)
Antibodies used: anti-DNP antibody, #5-8, #6-55, #7-34, #8-1, #8-4, #8-7, #8-8, #7, #10, #13, #22, and #33

TABLE 3-3

| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |
| 3 Primary antibody: | 50 µL/well | 60 min, 37° C. | Each antibody serially diluted 2-fold from 125 or 100 ng/mL/10% Block Ace |
| 4 Secondary antibody: | 50 µL/well | 60 min, 37° C. | HRP-anti-mouse IgG (H + L) in 10% Block Ace/PBS (1:1000) |

TABLE 3-3-continued

| 5 Chromogenic substrate: | 50 μL/well | 30 min, RT | OPD solution |
| 6 Reaction termination: | 50 μL/well | | 2N H₂SO₄ |
| 7 Measurement: | Wavelength 490 nm/630 nm | | |

O/N means overnight.

(Results)

Binding activity specific for human FSTL was confirmed. The strength of the binding activity was compared and was consequently #6-55 and #8-1₃#8-7₃#8-4>#8-8 (FIG. 64). As a result of further evaluating binding activity against human and mouse FSTL1, the strength of the binding activity against human FSTL1 was #6-55, #7-34, and #13>#8-1 and #10>#8-4>#7 and #33>#5-8>#22 (FIG. 65A). The strength of the binding activity against mouse FSTL1 was #6-55, #7-34, #10, and #13>#22>#7>#33>#8-1, and #8-1 very slightly exhibited binding activity (FIG. 65B). #5-8 and #8-4 exhibited no binding activity against mouse FSTL1.

<Example 3> Epitope Mapping of Antibody

In this Example, the antibodies obtained by preceding Examples were subjected to epitope mapping.

<Gene Synthesis>

For the synthesis of human and mouse FSTL1 genes, the sequences of His-tagged human and mouse FSTL1 genes were designed with reference to sequence information on NM_007085.4 (SEQ ID NO: 503) of the human FSTL1 gene and NM_008047.5 (SEQ ID NO: 505) of the mouse FSTL1 gene such that 3 alanine residues and 10 histidine residues were added to the C terminus. Further, codons were optimized in consideration of expression in mammalian cells. Genes in which nucleic acid sequences for plasmid insertion (SEQ ID NOs: 577 and 578) were respectively added to both ends of each gene were designed, and their synthesis was outsourced to Life Technologies Corp. The nucleic acid and amino acid sequences (SEQ ID NOs: 503, 504, 505, and 506) of the original human and mouse FSTL1 and the nucleic acid sequences of the actually synthesized genes and their amino acid sequences after translation (SEQ ID NOs: 571, 572, 573, and 574) are shown below. Sequence for insertion to plasmids: for N terminus:

```
5'-CGAACCCTTAAGCTTG-3'     (SEQ ID NO: 577)
``` for C terminus:

```
5'-CGTGGCATCTAGACA-3       (SEQ ID NO: 578)
``` human FSTL1 nucleic acid sequence (SEQ ID NO: 503) <In the following sequences, a leader sequence is underlined>

<u>atgtggaaacgctggctcgcgctcgcgctcgcgctggtggcggtcgcctg</u>

<u>ggtccgcgccg</u>aggaagagctaaggagcaaatccaagatctgtgccaatg tgttttgtggagccggccgggaatgtgcagtcacagagaagggga accc acctgtctctgcattgagcaatgcaaacctcacaagaggcctgtgtgtgg cagtaatggcaagacctacctcaaccactgtgaactgcatcgagatgcct gcctcactggatccaaaatccaggttgattacgatggacactgcaaagag aagaaatccgtaagtccatctgccagcccagttgtttgctatcagtccaa ccgtgatgagctccgacgtcgcatcatccagtggctggaagctgagatca ttccagatggctggttctctaaaggcagcaactacagtgaaatcctagac aagtattttaagaactttgataatggtgattctcgcctggactccagtga attcctgaagtttgtggaacagaatgaaactgccatcaatattacaacgt atccagaccaggagaacaacaagttgcttaggggactctgtgttgatgct ctcattgaactgtctgatgaaaatgctgattggaaactcagcttccaaga gtttctcaagtgcctcaacccatctttcaaccctcctgagaagaagtgtg ccctggaggatgaaacgtatgcagatggagctgagaccgaggtggactgt aaccgctgtgtctgtgcctgtggaaattgggtctgtacagccatgacctg tgacggaaagaatcagaagggggcccagacccagacagaggaggagatga ccagatatgtccaggagctccaaaagcatcaggaaacagctgaaaagacc aagagagtgagcaccaaagagatctaa Mouse FSTL1 nucleic acid sequence (SEQ ID NO: 505)

<u>atgtggaaacgatggctggcgctctcgctggtgaccatcgccctggtcca</u>

<u>cggcg</u>aggaggaacctagaagcaaatccaagatctgcgccaatgtgttt gtggagctggcagggaatgtgccgtcacagagaaggggggagcccacgtgc ctctgcattgagcaatgcaaacctcacaagaggcctgtgtgtggcagtaa tggcaagacctacctcaaccactgtgaacttcatagagatgcctgcctca ctggatccaagatccaggttgattatgatgggcactgcaaagaaaagaag tctgcgagtccatctgccagcccagttgtctgctatcaagctaaccgcga tgagctccgacggcgcctcatccagtggctggaagctgagatcattccag atggctggttctctaaaggcagtaactacagtgagatcctagacaagtac tttaagagctttgataatggcgactctcacctggactccagtgaattcct gaaattcgtggagcagaatgaaacagccatcaacatcaccacttatgcag atcaggagaacaacaaactgctcagaagcctctgtgttgacgccctcatt gaactgtctgatgagaacgctgactggaaactcagcttccaagagttcct caagtgcctcaacccatccttcaaccctcctgagaagaagtgtgccctgg aggacgaaacctatgcagatggagctgagactgaggtggactgcaatcgc tgtgtctgttcctgtggccactgggtctgcacagcaatgacctgtgatgg aaagaatcagaaggggtccagacccacacagaggaggagaagacaggat atgtccaggaactccagaagcaccagggcacagcagaaaagaccaagaag gtgaacaccaaagagatctaa Nucleic acid sequence of human FSTL1 used in Examples (SEQ ID NO: 571)

<u>atgtggaagagatggctggccctggctctggcactggtggctgtggcttg</u>

<u>ggtgcgcgccg</u>aggaagaactgcggagcaagagcaagatctgcgccaacg tgttctgcggagccggcagagaatgtgccgtgaccgagagggcgagcct acctgcctgtgcatcgagcagtgcaagcccacaagaggcctgtgtgcgg cagcaacggcaagacctacctgaaccactgcgagctgcaccgggatgcct -continued
```
gtctgaccggcagcaagatccaggtggactacgacggccactgcaaagaa aagaaaagcgtgtccccagcgccagccccgtcgtgtgttaccagagcaa cagggacgagctgcggcggagaatcatccagtggctggaagccgagatca tccccgacggctggttcagcaagggcagcaactacagcgagatcctggac aagtacttcaagaacttcgacaacggcgacagcagactggacagcagcga gttcctgaagttcgtggaacagaacgagacagccatcaacatcaccacct accccgaccaggaaaacaacaagctgctgcggggcctgtgcgtggacgcc ctgattgagctgagcgacgagaacgccgactggaagctgagctttcagga atttctgaagtgcctgaaccccagcttcaaccccccgagaagaagtgcg ccctggaggacgagacatacgccgatggcgccgagacagaggtggactgc aacagatgcgtgtgcgcctgcggcaactgggtgtgcaccgccatgacctg cgacggcaagaatcagaagggcgcccagacccagaccgaagaagagatga ccagatacgtgcaggaactgcagaagcaccaggaaaccgccgaaaagacc aagcgggtgtccaccaaagagatcgccgctgcccaccaccatcaccatca tcaccaccaccattga
```
Nucleic acid sequence of mouse FSTL1 used in examples (SEQ ID NO: 573)

```
atgtggaagcggtggctggccctgagcctcgtgacaattgctctggtgca cggcgaggaagaacccagaagcaagagcaagatctgcgccaacgtgttct gcggagccggcagagaatgtgccgtgaccgagaagggcgagcctacctgc ctgtgcatcgagcagtgcaagcccacaagaggcctgtgtgcggcagcaa cggcaagacctacctgaaccactgcgagctgcaccgggatgcctgtctga ccggcagcaagatccaggtggactacgacggccactgcaaagagaagaag tccgccagccctagcgccagcccagtcgtgtgttaccaggccaaccggga cgagctgcggcggagactgattcagtggctggaagccgagatcatccccg acggctggttcagcaagggcagcaactacagcgagatcctggacaagtac ttcaagagcttcgacaacggcgacagccacctggacagcagcgagttcct gaagttcgtggaacagaacgagacagccatcaacatcaccacctacgccg accaggaaaacaacaagctgctgagaagcctgtgcgtggacgccctgatc gagctgagcgacgagaacgccgactggaagctgagctttcaggaatttct gaagtgcctgaaccccagcttcaacccccgagaagaaatgcgccctgg aagatgagacatacgccgacggcgccgagacagaggtggactgcaataga tgcgtgtgcagctgcggccactgggtgtgcaccgccatgacctgcgacgg caagaaccagaaaggcgtgcagacccacaccgaggaagagaaaaccggct acgtgcaggaactgcagaagcaccagggcaccgccgaaaagaccaagaaa gtgaacaccaaagagatcgccgctgcccaccaccatcaccatcatcacca ccaccattga
```
Human FSTL1 amino acid sequence (SEQ ID NO: 504)

<u>MWKRWLALALALVAVAWVRA</u>EEELRSKSKICANVFCGAGRECAVTEKGEP

TCLCIEQCKPHKRPVCGSNGKTYLNHCELHRDACLTGSKIQVDYDGHCKC

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCDGKNQKGAQTQTEEEMTRYVQELQKHQETAEKT

KRVSTKEI

Mouse FSTL1 amino acid sequence (SEQ ID NO: 506)

<u>MWKRWLALSLVTIALVHG</u>EEEPRSKSKICANVFCGAGRECAVTEKGEPTC

LCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

CVCSCGHWVCTAMTCDGKNQKGVQTHTEEEKTGYVQELQKHQGTAEKTKK

VNTKEI

Amino acid sequence of human FSTL1 used in Examples (SEQ ID NO: 572)

<u>MWKRWLALALALVAVAWVRA</u>EEELRSKSKICANVFCGAGRECAVTEKGEP

TCLCIEQCKPHKRPVCGSNGKTYLNHCELHRDACLTGSKIQVDYDGHCKE

KKSVSPSASPVVCYQSNRDELRRRIIQWLEAEIIPDGWFSKGSNYSEILD

KYFKNFDNGDSRLDSSEFLKFVEQNETAINITTYPDQENNKLLRGLCVDA

LIELSDENADWKLSFQEFLKCLNPSFNPPEKKCALEDETYADGAETEVDC

NRCVCACGNWVCTAMTCDGKNQKGAQTQTEEEMTRYVQELQKHQETAEKT

KRVSTKEIAAAHHHHHHHHHH

Amino acid sequence of mouse FSTL1 used in Examples (SEQ ID NO: 573)

<u>MWKRWLALSLVTIALVHG</u>EEEPRSKSKICANVFCGAGRECAVTEKGEPTC

LCIEQCKPHKRPVCGSNGKTYLNHCELHRDACLTGSKIQVDYDGHCKEKK

SASPSASPVVCYQANRDELRRRLIQWLEAEIIPDGWFSKGSNYSEILDKY

FKSFDNGDSHLDSSEFLKFVEQNETAINITTYADQENNKLLRSLCVDALI

ELSDENADWKLSFQEFLKCLNPSFNPPEKKCALEDETYADGAETEVDCNR

CVCSCGHWVCTAMTCDGKNQKGVQTHTEEEKTGYVQELQKHQGTAEKTKK

VNTKEIAAAHHHHHHHHHH

<Expression Vector Construction>

Next, the insertion of a multicloning site into pcDNA3.4TOPO® and a method for inserting the FSTL1 gene will be described.

The synthesis of sequences having a multicloning site given below was outsourced to FASMAC Corp. to synthesis single-stranded DNAs. Respective single-stranded DNAs are complementary to each other, and the synthesized single-stranded DNAs were prepared into a double strand and then inserted to pcDNA 3.4 TOPO® vector using pcDNA(TM) 3.4-TOPO® TA Cloning Kit (Life Technologies Corp., Cat # A14697).

Multicloning site sequence (SEQ ID NO: 575)
5'-AAGCTTGGATCCACTAGTGAATTCATCTACCAGCTAGCGTGGCATCTAGACACTCTCGA GA-3'

(SEQ ID NO: 576)
5'CTCGAGAGTGTCTAGATGCCACGCTAGCTGGTAGATGAATTCACTAGTGGATCCAAGCTT A-3'

E. coli was transformed with the plasmid obtained by the insertion of the multicloning site, and cultured, and plasmids were purified using PureYield™ Plasmid Midiprep System (Promega Corp., Cat # A2492). The purified plasmids were treated with restriction enzymes BamHI-HF (New England BioLabs Japan Inc. Cat # R3136L) and NheI-HF (New England BioLabs Japan Inc. Cat # R3131L) and subjected to 1% agarose electrophoresis. After the electrophoresis, the gels were stained with ethidium bromide, and the bands of the plasmids were excised. The plasmids were purified from the gels using NucleoSpin Gel and PCR Clean-up (Takara Bio Inc., Cat #740609.250).

The synthesized human FSTL1 (SEQ ID NO: 571) or mouse FSTL1 gene (SEQ ID NO: 573) was integrated into the plasmids treated with the restriction enzymes described above using GeneArt Seamless Cloning and Assembly Enzyme Mix (Invitrogen Corp., Cat # A14606), and E. coli was transformed with the resulting plasmids. The transformed E. coli was cultured. Plasmids were extracted and purified from the E. coli, and their DNA sequences were confirmed. Plasmids confirmed to have the intended human or mouse FSTL1 gene sequence as a result of the DNA sequencing were used as expression plasmids. The obtained human and mouse FSTL1 expression vectors were used in transient expression using Expi293™ Expression system (Life Technologies Corp., Cat # A14635). Culture supernatants after the expression were purified using HisPur Cobalt Resin (Thermo Fisher Scientific Inc., Cat #89964) and used as antigens for ELISA and epitope mapping ELISA.

<Preparation of FSTL1 Deletion Mutant>

Next, a method for preparing various deletion mutants will be shown. Expression vectors of deletion mutants were constructed using the human FSTL1 expression plasmid thus prepared as a template, primers for deletion mutant preparation, and KOD-Plus-Mutagenesis Kit (Toyobo Co., Ltd., Cat # SMK-101). The sites to be deleted were selected, except for sites rich in disulfide bond important for conformation, with reference to Uniprot No. Q12841 (see FIG. 66A) to prepare expression vectors of a deletion mutant containing deletion at amino acid positions 21 to 53 (Δ21-53), a deletion mutant containing deletion at amino acid positions 100 to 140 (Δ100-140), a deletion mutant containing deletion at amino acid positions 148 to 170 (Δ148-170), a deletion mutant containing deletion at amino acid positions 148 to 154 (Δ148-154), a deletion mutant containing deletion at amino acid positions 155 to 162 (Δ155-162), a deletion mutant containing deletion at amino acid positions 163 to 170 (Δ163-170), a deletion mutant containing deletion at amino acid positions 181 to 190 (Δ181-190), a deletion mutant containing deletion at amino acid positions 193 to 228 (Δ193-228), and a deletion mutant containing deletion at amino acid positions 233 to 289 (Δ233-289). These various deletion mutants were transiently expressed using Expi293™ Expression system.

Culture supernatants after the expression were purified using HisPur Cobalt Resin and used as antigens for epitope mapping ELISA.

Δ21-53 (Forward primer)
5'-TGCATCGAGCAGTGCAAGCCCCACA-3'   (SEQ ID NO: 579)

Δ21-53 (Reverse primer)
5'-GGCGCGCACCCAAGCCACAGCCACC-3'   (SEQ ID NO: 580)

Δ100-140 (Forward primer)
5'-AAGGGCAGCAACTACAGCGAGATCC-3'   (SEQ ID NO: 581)

Δ100-140 (Reverse primer)
5'-TTTGCAGTGGCCGTCGTAGTCCACC-3'   (SEQ ID NO: 582)

Δ148-170 (Forward primer)
5'-TTCGTGGAACAGAACGAGACAGCCA-3'   (SEQ ID NO: 583)

Δ148-170 (Reverse primer)
5'-CTCGCTGTAGTTGCTGCCCTTGCTG-3'   (SEQ ID NO: 584)

Δ181-190 (Forward primer)
5'-AAGCTGCTGCGGGGCCTGTGCGTGG-3'   (SEQ ID NO: 585)

Δ181-190 (Reverse primer)
5'-GTTGATGGCTGTCTCGTTCTGTTCC-3'   (SEQ ID NO: 586)

Δ193-228 (Forward primer)
5'-CCCGAGAAGAAGTGCGCCCTGGAGG-3'   (SEQ ID NO: 587)

Δ193-228 (Reverse primer)
5'-CAGCTTGTTGTTTTCCTGGTCGGGG-3'   (SEQ ID NO: 588)

Δ233-289 (Forward primer)
5'-CTGCAGAAGCACCAGGAAACCGCCG-3'   (SEQ ID NO: 589)

Δ233-289 (Reverse primer)
5'-CTTCTTCTCGGGGGGTTGAAGCTG-3'   (SEQ ID NO: 590)

Δ148-154 (Forward primer)
5'-AACTTCGACAACGGCGACAGCAGACT-3'  (SEQ ID NO: 591)

Δ148-154 (Reverse primer)
5'-CTCGCTGTAGTTGCTGCCCTTGCTG-3'   (SEQ ID NO: 592)

Δ155-162 (Forward primer)
5'-CTGGACAGCAGCGAGTTCCTGAAGT-3'   (SEQ ID NO: 593)

Δ155-162 (Reverse primer)
5'-CTTGAAGTACTTGTCCAGGATCTCG-3'   (SEQ ID NO: 594)

Δ163-170 (Forward primer)
5'-TTCGTGGAACAGAACGAGACAGCCA-3'   (SEQ ID NO: 595)

Δ163-170 (Reverse primer)
5'-TCTGCTGTCGCCGTTGTCGAAGTTC-3'   (SEQ ID NO: 596)

Δ193-204 (Forward primer)
5'-AGCGACGAGAACGCCGACTGG-3'       (SEQ ID NO: 718)

Δ193-204 (Reverse primer)
5'-CAGCTTGTTGTTTTCCTGGTCGGGG-3'   (SEQ ID NO: 719)

Δ205-216 (Forward primer)
5'-GAATTTCTGAAGTGCCTGAAC-3'       (SEQ ID NO: 720)

Δ205-216 (Reverse primer)
5'-CAGCTCAATCAGGGCGTCCAC-3'       (SEQ ID NO: 721)

Δ217-228 (Forward primer)
5'-CCCGAGAAGAAGTGCGCCCTGGAGG-3'   (SEQ ID NO: 722)

Δ217-228 (Reverse primer)
5'-CTGAAAGCTCAGCTTCCAGTC-3'       (SEQ ID NO: 723)

Δ233-251 (Forward primer)
5'-AGATGCGTGTGCGCCTGCGGC-3'       (SEQ ID NO: 724)

```
Δ233-251 (Reveree primer)
5'-CTTCTTCTCGGGGGGGTTGAAGCTG-3'    (SEQ ID NO: 725)

Δ252-270 (Forward primer)
5'-AATCAGAAGGGCGCCCAGACC-3'        (SEQ ID NO: 726)

Δ252-270 (Reverse primer)
5'-GTTGCAGTCCACCTCTGTCTCG-3'       (SEQ ID NO: 727)

Δ271-289 (Forward primer)
5'-CTTCTTCTCGGGGGGTTGAAGCTG-3'     (SEQ ID NO: 728)

Δ271-289 (Reverse primer)
5'-CTTGCCGTCGCAGGTCATGGCG-3'       (SEQ ID NO: 729)

Δ48-100 (Forward primer)
5'-AAGAAAAGCGTGTCCCCCAGC-3'        (SEQ ID NO: 730)

Δ48-100 (Reverse primer)
5'-CTTCTCGGTCACGGCACATTC-3'        (SEQ ID NO: 731)
```

<Epitope Mapping ELISA>

Epitope mapping ELISA was conducted using the antigens thus prepared and antibodies given below. Antibodies used: various chicken-mouse chimeric antibodies obtained in Example 1, a rat anti-FSTL1 antibody (R&D Systems, Inc., Cat. No. MAB1694, clone 229007) evaluated in Examples of the patent literature WO2009/028411, an anti-DNP antibody as a negative control, and a rat IgG2b isotype control (R&D Systems, Inc., Cat. No. MAB0061, clone 141945)

(Table 4 Epitope Mapping ELISA Conditions)

TABLE 3-4

| 1 Immobilized antigen: | 50 μL/well | O/N, 4° C. | 5 μg/mL various human FSTL1 deletion mutants |
|---|---|---|---|
| 2 Blocking: | 250 μL/well | 60 min, 37° C. | 25% Block Ace/PBS |
| 3 Primary antibody: | 50 μL/well | 60 min, 37° C. | Each antibody 1 μg/mL/10% Block Ace |
| 4 Secondary antibody: | 50 μL/well | 60 min, 37° C. | HRP-anti-mouse IgG (H + L) or HRP-anti-Rat IgG (H + L) (Cell Signalling Technology, Inc., #7077S) in 10% Block Ace/PBS (1:1000) |
| 5 Chromogenic substrate: | 50 μL/well | 30 min, RT | OPD solution |
| 6 Reaction termination: | 50 μL/well | | 2N $H_2SO_4$ |
| 7 Measurement: | Wavelength 490 nm/630 mn | | |

Figure 66:
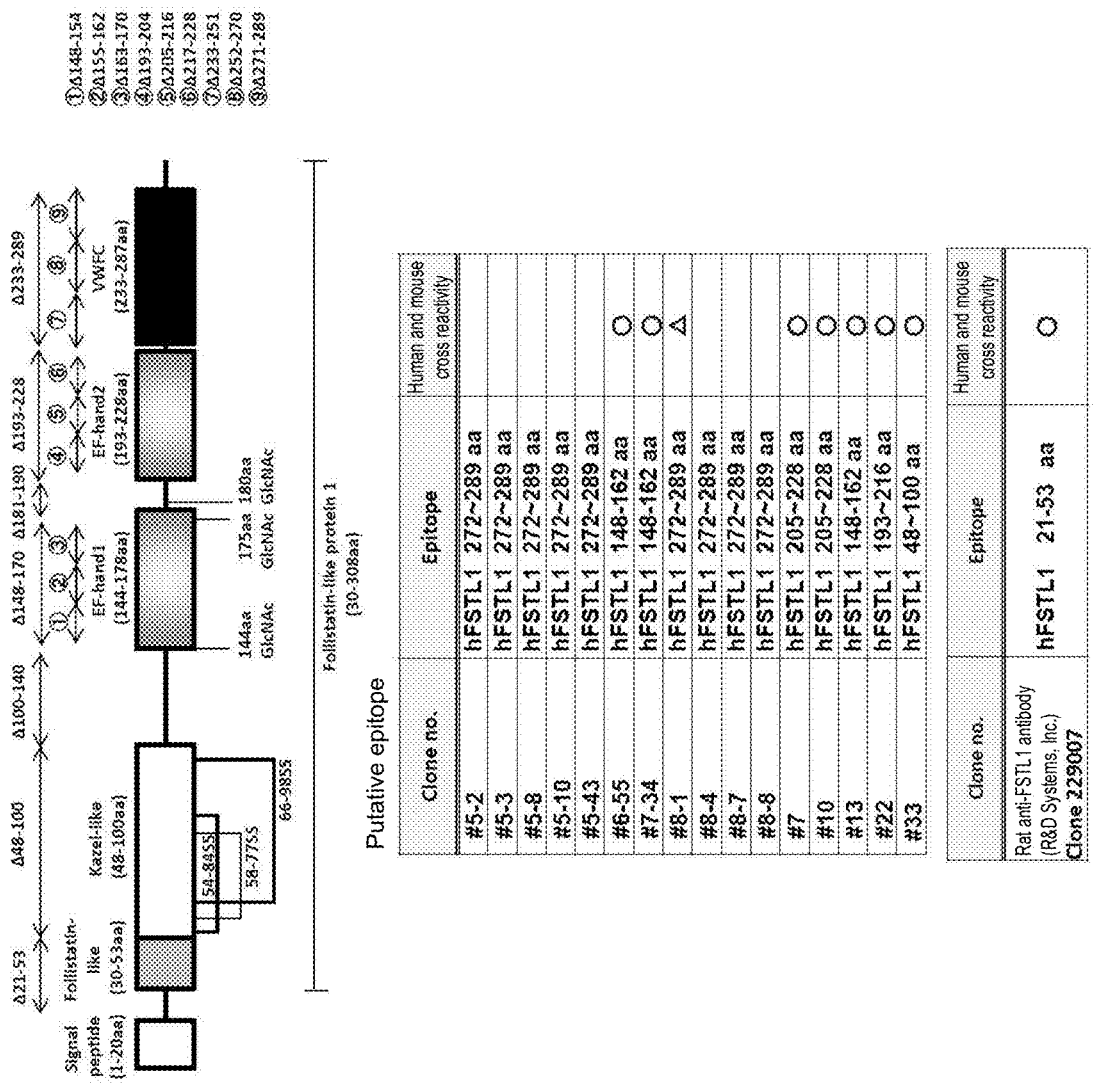
FIG. 66 shows deletion mutants and putative epitopes (Example 3). The upper diagram of FIG. 66 shows a schematic diagram of human FSTL1 and the positions of deletion sites. A putative epitope site for each clone was identified by ELISA using these deletion mutants of human FSTL1 as antigens. The lower diagram of FIG. 66 shows the comparison of putative epitopes between the obtained clones and a rat anti-FSTL1 antibody of R&D Systems, Inc. evaluated in Examples of Patent Literature 1 (WO2009/028411) in a table. Further, clones that exhibit the cross reactivity between humans and mice (strong binding activity: circle, weak binding activity: triangle) are described. As for criteria for strong or weak binding activity, binding activity found for both humans and mice at a concentration of 12.5 ng/ml was classified as "strong", and binding activity found for both humans and mice only at a higher concentration was classified as "weak".

The upper diagram of FIG. 66 shows a schematic diagram of human FSTL1 (with reference to Uniprot, No. Q12841) and the respective deletion sites of the prepared deletion mutants. As a result of the epitope mapping ELISA, the epitope site for each antibody is shown in the lower diagram of FIG. 66. As seen, #5-2, #5-3, #5-8, #5-10, #5-43, #8-1, #8-2, #8-4, and #8-7 were presumed to recognize a sequence contained in the amino acid sequence from positions 233 to 289 as an epitope, and #7, #10, and #22 were presumed to recognize a sequence contained in the amino acid sequence of positions 193 to 228 as an epitope. The epitope for the rat anti-FSLT1 antibody manufactured by R&D Systems, Inc. was predicted as a sequence contained in the amino acid sequence of positions 21 to 53 and thus found to be different from the epitopes for the various antibodies obtained in Example 1. #6-55, #7-34, and #13 were presumed to recognize a sequence contained in the amino acid sequence of positions 148 to 170 as an epitope. Further, these clones were judged as promising antibody clones by in vitro evaluation mentioned later. Therefore, the epitope sequence in the epitope-containing amino acid sequence of 148 to 170 was narrowed down. Specifically, a deletion mutant containing deletion at amino acid positions 148 to 154 (Δ148-154), a deletion mutant containing deletion at amino acid positions 155 to 162 (Δ155-162), and a deletion mutant containing deletion at amino acid positions 163 to 170 (Δ163-170) were prepared and subjected to epitope mapping ELISA in the same way as above. As a result, the epitope sites for #6-55, #7-34, and #13 are shown in the lower diagram of FIG. 66. As seen, these clones were presumed to recognize a sequence contained in the amino acid sequence of positions 148 to 162 as an epitope.

<Further Narrowing Down of Epitope>

The amino acid sequence of positions 148 to 170 (epitope for #6-55, #7-34, and #13), the amino acid sequence of positions 193 to 228 (epitope for #7, #10, and #22), and the amino acid sequence of positions 233 to 289 (epitope for #5-2, #5-3, #5-8, #5-10, #5-43, #8-1, #8-4, #8-7, and #8-8) were further fragmented as deletion sequences, and the epitope sequences were narrowed down. An epitope for clone #33 was identified.

The lower diagram of FIG. 66 reflects summary of these results. The putative epitope for #33 was present in the amino acid sequence of positions 48 to 100. The putative epitope for #7 and #10 was present in the amino acid sequence of positions 205 to 228. The putative epitope for #22 was present in the amino acid sequence of positions 193 to 216. The putative epitope for #5-2, #5-3, #5-10, #5-43, #8-1, #8-4, #8-7, and #8-10 was present in the amino acid sequence of positions 272 to 289.

Example 4: Evaluate of Inhibitory Activity Against Mesenchymal Stem Cell (MSC) Induction In this Example, inhibitory activity against the induction of mesenchymal stem cells (MSCs) by FSTL1 was evaluated.

It is known that when bone marrow cells are stimulated with FSTL1, mesenchymal stem cells (MSCs) having pluripotency or self-proliferative capacity grow (Cancer Research 73: 6185, 2013). Thus, $2 \times 10^7$ cells/well of bone marrow cells collected from the thigh bone of a C57BL/6 mouse were suspended in 3 mL/well of RPMI1640 (GIBCO/Thermo Fisher Scientific Inc., Cat. No. C11875500BT) medium containing 2% fetal bovine serum, supplemented with 50 ng/mL (final concentration) of FSTL1 (R&D Systems, Inc. Cat #1694-FN-050) and 10 μg/mL of the anti-FSTL1 antibody (#5-2, #5-3, #5-8, #5-10, #5-43, #6-55, or #7-34) or its isotype mouse IgG (anti-DNP antibody) as a control antibody "Control", and cultured under stimulation (6-well plate). 11 days thereafter, the number of cells was counted while the cells were stained with a PE-labeled anti-ALCAM antibody (eBioscience, Cat. No. 12-1661-82) and a PE-labeled anti-PDGFRA antibody (eBioscience, Cat #12-1401-81) in order to examine the expression of MSC markers, and the contents of ALCAM-positive cells and PDGFR-positive cells were analyzed by flow cytometry using FACScan (Becton, Dickinson and Company, Code. BECTON-DICKINSON-FACSCAN) to calculate the number of each positive cell per culture. As a result, all of the antibody clones exhibited inhibitory activity against the expansion of ALCAM-positive cells and PDGFRA-positive cells by FSTL1, as compared with the control antibody (anti-DNP antibody). Among them, #5-43, #6-55, and #7-34 exhibited slightly strong tendency of inhibitory activity.

Example 5: Evaluation of Inhibitory Activity Against Activation of Tumor Cell by FSTL1

In this Example, inhibitory activity against the activation of tumor cells by FSTL1 was evaluated.

It is known that tumor cells activated by stimulation with FSTL1 highly express molecule groups promoting bone metastasis and increase metastatic invasive capacity (Cancer Research 73: 6185, 2013). Thus, $2 \times 10^7$ cells/well of a human pancreatic cancer cell line Pancl were suspended in 1 mL/well of D-MEM medium (GIBCO/Thermo Fisher Scientific Inc. Cat. No. C11885500BT) containing 10% fetal bovine serum, supplemented with 50 ng/mL (final concentration) of FSTL1 (R&D Systems, Inc.) and 10 µg/mL of the anti-FSTL1 antibody (#5-2, #5-8, #5-10, #5-43, #6-55, or #7-34) or its isotype mouse IgG (anti-DNP antibody) as a control antibody "Control", and cultured under stimulation (6-well plate). 3 days thereafter, the number of cells was counted while the cells were stained with a PE-labeled anti-RANKL antibody (eBioscience Cat. No. 12-6619) and a PE-labeled anti-CCR2 antibody (R&D Systems, Inc. Cat. No. FAB151P) in order to examine the expression of markers indicating bone metastatic properties, and the contents of RANKL-positive cells and CCR2-positive cells were analyzed by flow cytometry using FACScan (Becton, Dickinson and Company) to calculate the numbers of cells per culture. As a result, all of the antibody clones exhibited inhibitory activity against the expansion of RANKL-positive cells by FSTL1, as compared with the control antibody (anti-DNP antibody). The results of this experiment revealed that when the content of RANKL-positive cells and the number of cells per culture were compared, the number of cells was confirmed to be more appropriate for evaluation. Therefore, in Examples below, judgment was made with the number of cells as an index.

Example 6: Evaluation of Inhibitory Activity Against Induction of Mesenchymal Stem Cell (MSC) by FSTL1

In this Example, the same experiment as in Example 4 was conducted.

Figure 67:
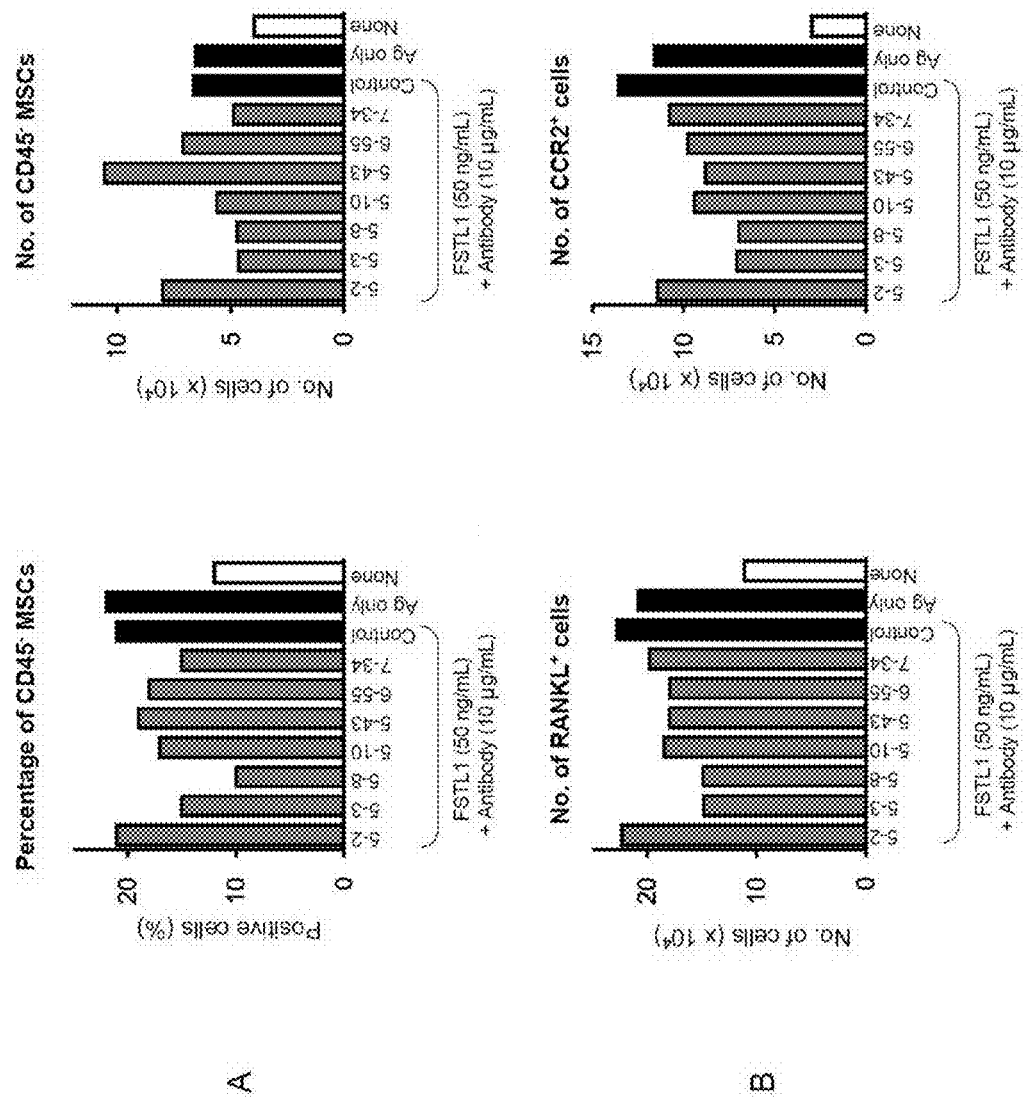
FIG. 67 shows results indicating effects brought about by the suppression of FSTL1 on mesenchymal stem cells (MSCs) and bone metastasis (Examples 6 and 7). Part A shows the influence of antibodies on an effect of inducing mouse bone marrow-derived mesenchymal stem cells by FSTL1 (Example 6). The proportion of mesenchymal stem cell (MSC) marker CD45-negative cells was analyzed by flow cytometry, and the percentage and number of the cells were shown. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity against the action of FSTL1, as compared with the control antibody (anti-DNP antibody). Among them, clone #5-3, #5-8, and #7-34 exhibited higher inhibitory activity and substantially completely inhibited the action of FSTL1. Part B shows the influence of antibodies on an effect of inducing RANKL- and CCR2-positive cells in a human pancreatic cancer cell line Pancl by FSTL1 (Example 7). The expression of RANKL and CCR2 among molecules known as bone metastasis markers was analyzed by flow cytometry, and the numbers of positive cells were indicated in graphs. The clones shown in the graphs are depicted on the left bars, a control antibody (anti-DNP antibody) is depicted on the third bar from the right, an antigen alone is depicted on the second bar from the right, and a non-supplemented sample is depicted on the rightmost bar. All of the antibody clones exhibited inhibitory activity, as compared with the control antibody (anti-DNP antibody). Particularly, clone #5-3 and #5-8 exhibited higher inhibitory activity.

Mouse bone marrow cells prepared in the same way as in Example 4 were supplemented with 50 ng/mL (final concentration) of FSTL1 and 10 µg/mL of the anti-FSTL1 antibody (#5-2, #5-3, #5-8, #5-10, #5-43, #6-55, or #7-34) or a control antibody anti-DNP antibody and cultured under stimulation. 11 days thereafter, the number of cells was counted while the cells were stained with a PE-Cy5-labeled anti-CD45 antibody (BD Pharmingen/Becton, Dickinson and Company, Cat. No. 555484), and the content of CD45-negative cells reported to generally contain MSCs at a high rate was analyzed by flow cytometry using FACScan to calculate the percentage and number of MSCs per culture (FIG. 67A). As a result, all of the antibody clones exhibited inhibitory activity against the expansion of CD45-negative cells by FSTL1, as compared with the control antibody. Among them, #5-3, #5-8, #7-34, and #5-43 exhibited higher inhibitory activity and substantially completely inhibited the action of FSTL1.

Example 7: Evaluation of Inhibitory Activity Against Activation of Tumor Cell by FSTL1

In this Example, inhibitory activity against the activation of tumor cells by FSTL1 was evaluated in RANKL-positive cells and CCR2-positive cells.

In the same way as in Example 5, a human pancreatic cancer cell line Pancl was supplemented with 50 ng/mL (final concentration) of FSTL1 (R&D Systems, Inc.) and 10 µg/mL of the anti-FSTL1 antibody (the same clones as in Example 6) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 67B). As a result, all of the antibody clones exhibited inhibitory activity against the expansion of RANKL-positive cells and CCR2-positive cells, as compared with the control antibody. Among them, #5-3 and #5-8 exhibited higher inhibitory activity.

Example 8: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated in the same way as in Examples 4 and 6 except that the concentration was changed.

Mouse bone marrow cells prepared in the same way as in Example 4 were supplemented with 20 ng/mL (final concentration) of FSTL1 and 10 µg/mL of the anti-FSTL1 antibody (#5-2, #5-3, #5-8, #5-10, #5-43, #6-55, #8-1, #8-4, #8-7, and #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 68A). As a result, #5-8, #5-43, #6-55, #8-1, and #8-4 exhibited inhibitory activity against the expansion of CD45-negative cells by FSTL1, as compared with the control antibody.

Example 9: Evaluation of Inhibitory Activity Against Activation of Tumor Cell by FSTL1

In this Example, inhibitory activity against the activation of tumor cells by FSTL1 was evaluated at lower concentration.

In the same way as in Example 5, a human pancreatic cancer cell line Pancl was supplemented with 20 ng/mL (final concentration) of FSTL1 and 10 µg/mL of the anti-FSTL1 antibody (#5-2, #5-8, or #6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 68B). As a result, #5-8 and #6-55 also exhibited inhibitory activity against the expansion of RANKL-positive cells and CCR2-positive cells using the concentration of 20 ng/mL (final concentration), as compared with the control antibody.

Example 10: Evaluation of Inhibitory Activity Against Activation of Tumor Cell by FSTL1

In this Example, inhibitory activity against the activation of tumor cells by FSTL1 was evaluated, also including newly obtained clones.

In the same way as in Example 5, a human pancreatic cancer cell line Panc1 was supplemented with 50 ng/mL (final concentration) of FSTL1 and 10 µg/mL of the anti-FSTL1 antibody (#5-2, #5-3, #6-55, #7-34, #8-1, #8-4, #8-7, or #8-8) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, #5-2, #6-55, #8-4, and #8-7 exhibited high inhibitory activity against the expansion of RANKL-positive cells and CCR2-positive cells, as compared with the control antibody (FIG. 68C).

Example 11: Evaluation of Inhibitory Activity Against Activation of Tumor Cell by FSTL1 (Dose Dependence Test)

In this Example, inhibitory activity against the activation of tumor cells by FSTL1 was evaluated at varying doses including a low dose.

In the same way as in Example 5, a human pancreatic cancer cell line Panc1 was supplemented with 50 ng/mL (final concentration) of FSTL1 and 10 µg/mL of the anti-FSTL1 antibody (#6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, the tested #6-55 exhibited substantially 100% inhibitory activity against the expansion of RANKL-positive cells and CCR2-positive cells at all of the tested doses (5 µg/mL, 10 µg/mL, and 20 µg/mL), as compared with the control antibody, though the dose dependence of antibody was not confirmed (FIG. 68D).

Example 12: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated, including further clones.

Mouse bone marrow cells prepared in the same way as in Example 4 were supplemented with 20 ng/mL (final concentration) of FSTL1 and 10 µg/mL of the anti-FSTL1 antibody (#5-2, #5-8, #6-55, #7-34, #8-1, #8-4, #8-7, or #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 69). As a result, all of the clones exhibited inhibitory activity against the expansion of CD45-negative cells by FSTL1, as compared with the control. Particularly, higher inhibitory activity was confirmed in the order of #7-34, #5-2, #6-55, and #8-7.

<Example 13: Evaluation of Inhibitory Activity Against Induction of Mesenchymal Stem Cell (MSC), Cancer-Associated MSC, and Myeloid-Derived Suppressor Cell (MDSC) by FSTL1>

In this Example, inhibitory activity against the induction of mesenchymal stem cells (MSC), cancer-associated MSCs, and myeloid-derived suppressor cells (MDSCs) by FSTL1 was evaluated.

Mouse bone marrow cells prepared in the same way as in Example 4 were supplemented with 20 ng/mL (final concentration) of FSTL1 and 10 µg/mL of the anti-FSTL1 antibody (#6-55, #7-34, #8-1, or #8-4), an anti-PD-L1 antibody reported to have an immunosuppression-mitigating effect, or a control antibody anti-DNP antibody and cultured under stimulation. 8 days thereafter, the number of cells was counted while the cells were stained with a PE-Cy5-labeled anti-CD45 antibody, a PE-labeled anti-ALCAM antibody, a FITC-labeled anti-CD271 antibody (Abcam plc, Cat. No. AB62122), a FITC-labeled anti-CD11b antibody (BD Pharmingen/Becton, Dickinson and Company, Cat. No. 553310), and a PE-Cy5-labeled anti-Gr1 antibody (eBioscience, Cat. No. 15-5931) in order to detect MSCs (CD45-negative cells), cancer-associated MSCs (CD45-negative, ALCAM-positive, and CD271-positive cells) which are MSCs increasing in number in association with cancer metastasis, and monocytic myeloid-derived suppressor cells (M-MDSCs: CD11b-positive, Gr1-positive, and ALCAM-positive cells) increasing in number together with cancer-associated MSCs, and the contents of the cells mentioned above were analyzed by flow cytometry using FACScan to calculate the percentage and number of MSCs per culture (FIG. 70). As a result, all of the clones exhibited high inhibitory activity against the induction of MSCs, cancer-associated MSCs, and M-MDSCs by FSTL1, as compared with the control antibody. PD-L1 is expressed in MSC and presumably influences the induction of MSCs. However, inhibitory activity was found to be stronger in the anti-FSTL1 antibodies.

<Example 14: Evaluation of Inhibitory Activity Against Induction of Mesenchymal Stem Cell (MSC), Cancer-Associated MSC, and Myeloid-Derived Suppressor Cell (MDSC) by FSTL1, and Evaluation of Ability to Differentiate into Adipocyte)>

In this Example, inhibitory activity against the induction of mesenchymal stem cells (MSCs), cancer-associated MSCs, and myeloid-derived suppressor cells (MDSCs) by FSTL1 was evaluated.

The antibody clone (#6-55, #7, #10, #13, or #22) was evaluated for its activity by the same testing method as in Example 13. #6-55 was set as a positive control for activity. As a result, all of the clones exhibited inhibitory activity against the induction of MSCs, cancer-associated MSCs, and M-MDSCs by FSTL1, as compared with the control antibody. Among them, #13 exhibited inhibitory activity equivalent to or higher than that of the positive control (FIG. 71A). These results seem to be reasonable because epitopes for #13 and #6-55 are the same regions. FIG. 71B shows results of analyzing inhibitory activity against the induction of MSCs having the ability to differentiate into adipocytes. Mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation. In the graph, none is depicted in the leftmost bar, and the control antibody is depicted in the second bar from the left followed by the anti-FSLT1 antibody clones. Adipocytes were not confirmed for any of the anti-FSLT1 antibodies. It is understood that the differentiation induction of MSCs serving as the original source is inhibited.

Example 15: Comparison with Conventional Antibody

In this Example, activity was compared with an anti-FSTL1 antibody (manufactured by R&D Systems, Inc.) evaluated in Examples of Patent Literature 1 (WO2009/028411).

FSTL1 inhibitory activity was compared between the rat anti-FSTL1 antibody of R&D Systems, Inc. (Cat. No. MAB1694, clone 229007) found in Patent Literature 1 (WO2009/028411) to exhibit inhibitory activity against the induction of regulatory T cells important for immunosuppression, and #6-55 of the present invention.

Mouse bone marrow cells (bone marrow cells prepared in the same way as in Example 4) were supplemented with 20 ng/mL (final concentration) of FSTL1 and 20.0, 10.0, 5.0, or 2.5 µg/ml (final concentration) of the rat anti-FSTL1 antibody or #6-55. Also, mouse bone marrow cells were supplemented with 20.0 µg/ml (final concentration) each of their respective control antibodies, a rat IgG2b isotype control (R&D Systems, Inc., Cat. No. MAB0061, clone 141945) and an anti-DNP antibody. The cells were cultured for 8 days, and the inhibitory activity of each antibody against the induction of MSCs, cancer-associated MSCs, and M-MDSCs by FSTL1 was evaluated in the same way as in Example 13 (FIG. 72A). As a result, the inhibitory activity of the rat anti-FSTL1 antibody and the antibody of #6-55 was at the same level. On the other hand, dose dependence was not confirmed. The inhibition of regulatory T cells shown in Patent Literature 1 (WO2009/028411) is presumably a consequence mediated by the inhibition of MSC induction.

Example 16: Evaluation of Inhibitory Activity Against Induction of Mesenchymal Stem Cell (MSC) by FSTL1 (Evaluation of Ability to Differentiate into Adipocyte)

In this Example, the ability to differentiate into adipocytes was evaluated in order to evaluate inhibitory activity against an effect of inducing mesenchymal stem cell (MSC)-mediated immunosuppression by FSTL1.

In the same way as in Example 15, mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation (FIG. 72B). As a result, cells differentiating into adipocytes decreased in number by the addition of #6-55 in a dose-dependent manner, as compared with the anti-DNP antibody (mouse IgG control group). On the other hand, in the case of adding the rat anti-FSTL1 antibody of R&D Systems, Inc., no influence was confirmed on differentiation into adipocytes, and a large number of adipocytes were observed at all of the doses, as in the rat IgG2b isotype control group. Specifically, not all of cells in a CD45-negative cell population are MSCs, and this population is merely a cell population containing MSCs at a high rate. It was shown that although the CD45-negative cells decreased in number by the rat anti-FSTL1 antibody of R&D Systems, Inc., there still remained many MSCs differentiating into adipocytes.

Example 17: In Vivo Antibody Activity Evaluation-Intratumoral Administration

In this Example, the drug efficacy of the anti-FSTL1 antibody was evaluated by intratumoral administration using bone metastasis models having a transplant of mouse melanoma B16-F10 cells forced to express Snail.

<Method and Material>

Three antibodies were comparatively analyzed for their antitumor effects and an immunosuppression-mitigating effect using bone metastasis models in which mouse melanoma cells B16-F10 forced to express Snail were subcutaneously and intravenously transplanted in C57BL/6N mice.
1. Experiment group (n=5)
1. No treatment
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5 \times 10^5$ cells subcutaneously & $1 \times 10^5$ cells intravenously)
Day 7: intratumoral administration of the antibody (200 µg/0.1 mL/tumor)
Day 14: various assays (with a focus on flow cytometry analysis)
3. Index for drug efficacy evaluation
Effects on the growth of subcutaneous tumor (calculation of tumor volume by tumor size measurement): measured 7, 11, and 14 days after tumor implantation (FIG. 73C)
Effects on bone metastasis (GFP-positive tumor cells in bone marrow) (FIG. 73A)
Effects on the expansion of mesenchymal stem cells (CD45-negative cells in bone marrow and in the spleen) (FIGS. 73B and 73D)
Effects on the expansion of immunosuppressive Treg cells (CD4-positive and Foxp3-positive cells in bone marrow or the spleen) (FIG. 73D)
Other immunosuppressive properties (FIG. 73D)

DESCRIPTION

In order to evaluate in vivo antibody activity, antitumor effects and immunosuppression-mitigating effects were comparatively analyzed using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5\times10^5$ cells subcutaneously & $1\times10^5$ cells intravenously) were transplanted. On day 7, the antibody was administered into subcutaneous tumor (200 μg/0.1 mL/tumor). On day 14, various assays were conducted.

It is known that when Snail-positive tumor cells are subcutaneously or intravenously transplanted to mice, the tumor metastasizes preferentially to bone marrow in addition to various organs, and this incurs the expansion of mesenchymal stem cells (MSCs) originating in the bone marrow, thereby systemically and strongly suppressing the induction of antitumor immunity (Cancer Research 73: 6185, 2013). Thus, GFP-positive and Snail-positive B16-F10 tumor cells forced to express GFP and Snail by the transfer of the GFP gene and the mouse Snail gene were transplanted subcutaneously ($5\times10^5$ cells) and into the tail vein ($1\times10^5$ cells). 7 days thereafter, 10 mg/kg of the anti-FSTL1 antibody (#6-55, #7-34, or #8-1) or its isotype control antibody mouse IgG (anti-DNP antibody) adjusted to 1 mg/ml with saline was inoculated into tumor (5 mice/group). First, subcutaneous tumor size was measured before assays, and the tumor volume was calculated to evaluate an inhibitory effect on subcutaneous tumor growth (FIG. 73C (change of each individual is shown)). 7 days after antibody administration (14 days after tumor implantation), bone marrow cells or spleen cells were collected from the mice, and the number of cells per mouse was counted while drug efficacy was comparatively analyzed in more detail by flow cytometry analysis using FACScan (Becton, Dickinson and Company). Specifically, a) the content of GFP-positive and Snail-positive B16-F10 tumor cells in the bone marrow cells was analyzed to evaluate an inhibitory effect on bone metastasis (FIG. 73A). The percentage (%) of CD45⁻ cells in the bone marrow cells was analyzed by flow cytometry. Then, the number of CD45-negative bone marrow cells ($\times10^6$ cells) per mouse was counted on the basis of this data (FIG. 73B). The effects of various antibodies on MSC expansion in bone marrow are shown. b) The content of CD45-negative cells in the spleen was analyzed (PE-Cy5-labeled anti-CD45 antibody, Becton, Dickinson and Company) to evaluate an inhibitory effect on MSC expansion (left graph of FIG. 73D). c) The contents of immunosuppressive CD4-positive and Foxp3-positive cells (PE-labeled anti-CD4 antibody, Becton, Dickinson and Company; FITC-labeled anti-Foxp3 antibody, eBioscience) (middle graph of FIG. 73D) which are reportedly induced by MSCs, and CD8-positive and Tim3-positive T cells (CyChrome-labeled anti-CD8 antibody, Becton, Dickinson and Company; FITC-labeled anti-Tim3 antibody, R&D Systems, Inc.) exhausted to fall into dysfunction (right graph of FIG. 73D) were analyzed in bone marrow or the spleen to evaluate an immunosuppression-mitigating effect.

(Results)

The results are shown in FIG. 73. Antitumor effects and immunosuppression-mitigating effects, etc. were comparatively analyzed using bone metastasis models in which mouse melanoma cells (B16-F10) forced to express Snail were subcutaneously and intravenously transplanted in C57BL/6N mice. Intratumoral administration was performed as a method for administering the anti-FSTL1 antibody to be tested. All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34. FIG. 73D shows change in cell populations in the spleen. As shown, even if an antibody is administered locally, for example, into tumor, the whole body receives modification or influence. The left graph of FIG. 73D shows the number of CD45-negative cells and shows that MSCs also decrease in number in the spleen. The middle graph of FIG. 73D shows that CD4-positive and Foxp3-positive T cells decrease in number and shows that Tregs (regulatory T cells) decrease in number. The right graph of FIG. 73D shows the number of CD8-positive and Tim3-positive T cells and demonstrated that exhausted CD8-positive T cells decrease in number. In this context, the "exhaustion" refers to a state having functional decline or dysfunction. Tim3 is a marker that reflects the state. If CD8-positive T cells supposed to kill tumor cells fall into an exhausted state, cancer cells cannot be eliminated from the living body. Thus, it can be concluded that the effects of the present invention exhibit remarkable effects of suppressing the enhancement of such immunosuppression.

Example 18: In Vivo Antibody Activity Evaluation-Intraperitoneal Administration

In this Example, the drug efficacy of the anti-FSTL1 antibody was evaluated by systemic administration (intraperitoneal administration) using bone metastasis models having a transplant of mouse melanoma B16-F10 cells forced to express Snail.
1. Experiment group (n=5)
1. No treatment (0.9% NaCl as a sham)
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5\times10^5$ cells subcutaneously & $1\times10^5$ cells intravenously)
Day 5: intraperitoneal administration of the antibody (first dose, corresponding to 200 μg/mouse=10 mg/kg)
Day 10: intraperitoneal administration of the antibody (second dose, corresponding to 200 μg/mouse=10 mg/kg)
Day 14: various immunological assays
  The intraperitoneal administration and the intravenous administration are pharmacologically used interchangeably with systemic administration methods.
3. Index for drug efficacy evaluation
  Effects on the growth of subcutaneous tumor (calculation of tumor volume by tumor size measurement): measured 7, 11, and 14 days after tumor implantation (FIG. 74B)
  Effects on bone metastasis (GFP-positive tumor cells in bone marrow or the spleen) (FIGS. 74A and 74C)
  Effects on MSC expansion (CD45-negative cells in bone marrow or the spleen) (FIGS. 74A and 74C)
  Effects on weight loss (FIG. 74A)
  Effects on the expansion of immunosuppressive Treg cells (CD4-positive and Foxp3-positive cells in the spleen) (FIG. 74C)
  Other immunosuppressive properties (FIG. 74C)

DESCRIPTION

In Example 17, the antibody was administered into tumor according to the purpose of "inhibiting metastasis from a primary focus to bone" as previously conducted by the present inventors. In this Example, the conditions of Example 17 were changed, and intraperitoneal administration generally performed in mouse experiments was adopted in consideration of the fact that antibody drugs are systemically administered in general. All procedures except for the antibody administration method were performed in the same way as in Example 17 above. Specifically, antitumor effects and immunosuppression-mitigating effects were comparatively analyzed by the intraperitoneal administration (systemic administration) of the anti-FSTL1 antibody using bone metastasis models in which mouse melanoma cells (B16-F10) forced to express Snail were subcutaneously and intravenously transplanted in C57BL/6N mice.

Also, assays were conducted 14 days after tumor implantation. The antibody was intraperitoneally administered at 10 mg/kg twice (5 and 10 days after tumor implantation) to the mice.

(Results)

The results are shown in FIG. 74. Intraperitoneal administration was performed as a method for administering the anti-FSTL1 antibody to be tested here. In in vivo evaluation, as in Example 17, all of the 3 anti-FSTL1 antibodies significantly suppressed the growth of subcutaneous tumor with respect to the control antibody (FIG. 74B). In addition, an anti-weight loss effect (right graph of FIG. 74A) was confirmed by the administration of #6-55 and #8-1. In light of these functional analysis results, even decrease in the number of Tregs, which has heretofore received attention in terms of immunosuppression, or the removal of the Tregs is not sufficient treatment for cancer treatment. Instead, the control of the whole immunosuppression cascade should be contemplated. It is expected that the targeting of MSCs positioned most upstream thereof is more effective. It can also be reconfirmed that the inhibition of even cancer metastasis (middle graph of FIG. 74A) at the same time with decrease in the number of MSCs (left graph of FIG. 74A) is further effective. The possibility is expected that inhibitory treatment targeting FSTL1 is effective for cancer treatment. FIG. 74C shows change in cell populations in the spleen. The upper left graph of FIG. 74C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Example 19: In Vivo Antibody Activity Evaluation-Comparison with Existing Drug

DESCRIPTION

Procedures and methods of the experiment were substantially the same as in Examples 17 and 18, and assays were conducted 15 days after tumor implantation.

An antibody given below was intraperitoneally administered as an existing drug at 10 mg/kg (200 μg/mouse) twice (4 and 8 days after tumor implantation) to the mice.

In this Example, therapeutic effects were comparatively studied using antibody drugs already clinically used for the purpose of "mitigation of immunosuppression", which is one mechanism of action of the anti-FSTL1 antibody, and Snail-positive tumor bone metastasis models. The antibody was systemically administered twice, as in the preceding test, according to general animal tests using antibody drugs.

1 Experiment group (n=5)
1 No treatment (0.9% NaCl as a sham)
2 Control IgG (anti-DNP)
3 Anti-FSTL1 mAb (#6-55)
4 Anti-CTLA4 mAb (Clone 9H10, BioLegend)
5 Anti-PD-1 mAb (Clone 29F.1A12, BioLegend)
6 Anti-PD-L1 mAb (Clone 10F.9G2, BioLegend)
7 Naive (no tumors, no treatment)
2 Experimental procedure
Day 0: transplantation of GFP-positive and Snail-positive B16-F10 tumor cells ($5 \times 10^5$ cells subcutaneously & $1 \times 10^5$ cells intravenously)
Day 4: intraperitoneal administration of the antibody (first dose, corresponding to 200 μg/mouse=10 mg/kg)
Day 8: intraperitoneal administration of the antibody (second dose, corresponding to 200 μg/mouse=10 mg/kg)
Day 15: various assays
3. Index for drug efficacy evaluation
  Effects on the growth of subcutaneous tumor (calculation of tumor volume by tumor size measurement): measured 8, 11, and 14 days after tumor implantation (FIG. 75A)
  Effects on bone metastasis (amount of GFP-positive tumor cells in bone marrow) (FIG. 75B)
  Effects on MSC expansion in bone marrow (FIG. 75B)
  Effects on weight loss (FIG. 75B)

(Results)

The results are shown in FIG. 75. In all of the treatment groups, all of subcutaneous tumor growth, bone metastasis, and expansion of mesenchymal stem cells (MSCs) increasing in number in, association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Example 20: In Vivo Antibody Activity Evaluation-Colorectal Cancer Model

In this Example, the drug efficacy of the anti-FSTL1 antibody was evaluated using mouse colorectal cancer CT26 cell-transplanted models.

Procedures and methods of the experiment were basically performed under substantially the same conditions as in the bone metastasis model experiments of Examples 17 to 19 except that bone metastasis was not evaluated. Specifically, drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The test was conducted by changing only the amount of tumor implanted, antibody administration timing, and assay timing.

Day 0: transplantation of tumor cells ($5 \times 10^5$ cells subcutaneously & $5 \times 10^5$ cells intravenously)

Days 4 and 7: intraperitoneal administration of the antibody (10 mg/kg)

Day 14: drug efficacy evaluation (subcutaneous tumor growth (FIG. 76A) and lung metastasis (FIG. 76B))

For lung metastasis, the number of metastatic nodules in the lung was macroscopically counted. The tumor volumes of the mice were measured 7, 11, and 14 days after tumor implantation.

(Results)

The results are shown in FIG. 76. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The results about the number of metastatic nodules in the lung are shown in FIG. 76B. The left bar depicts no treatment, the middle bar depicts an isotype control (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

Example 21: In Vivo Antibody Activity Evaluation-Breast Cancer Model

In this Example, the drug efficacy of the anti-FSTL1 antibody was evaluated using mouse breast cancer 4T1 cell-transplanted models.

Procedures and methods of the experiment were basically performed according to Examples 17 to 20 under substantially the same conditions as in the bone metastasis model experiments of Examples 17 to 20. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. Changes were made as follows.

Day 0: transplantation of tumor cells ($5 \times 10^5$ cells subcutaneously & $5 \times 10^5$ cells intravenously)

Days 4 and 7: intraperitoneal administration of the antibody (10 mg/kg)

Day 14: drug efficacy evaluation (subcutaneous tumor growth)

The tumor volumes of the mice were measured 4, 7, 11, and 14 days after tumor implantation.

(Results)

The results are shown in FIG. 77. The growth of 4T1 subcutaneous tumor was able to be significantly suppressed by the administration of the anti-FSTL1 antibody (#6-55).

Example 22: In Vivo Antibody Activity Evaluation-Melanoma B16-10

In this Example, the drug efficacy of the anti-FSTL1 antibody was evaluated using mouse melanoma B16-F10.

The drug efficacy of the anti-FSTL1 antibody was evaluated according to Examples 17 to 20 using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests.

1. Experiment group (n=5)
1. Mouse melanoma B16-F10+control IgG (anti-DNP mAb)
2. Mouse melanoma B16-F10+anti-FSTL1 mAb (#6-55)
2. Experimental procedure Day 0: transplantation of tumor cells ($1 \times 10^6$ cells subcutaneously & $1 \times 10^6$ cells intravenously)

Day 3: intraperitoneal administration of the antibody (first dose, corresponding to 200 µg/mouse=10 mg/kg)

Day 6: intraperitoneal administration of the antibody (second dose, corresponding to 200 µg/mouse=10 mg/kg)

Day 15 various immunological assays

3. Index for drug efficacy evaluation

Effects on the growth of subcutaneous tumor (calculation of tumor volume by tumor size measurement): measured 6, 10, and 14 days after tumor implantation (FIG. 78A)

Effects on weight loss (FIG. 78B)

(Results)

The results are shown in FIG. 78. Subcutaneous tumor growth was strongly suppressed by the administration of the anti-FSTL1 antibody (#6-55), as compared with the control antibody administration group. In the anti-FSTL1 antibody administration group, suppressive activity against weight loss was also exhibited (FIG. 78A), and neither remarkable emaciation nor fluffing, etc. was observed (FIG. 78B). Thus, all of the mice were fine. In this model, lung metastasis is usually observed 20 to 30 days after implantation. This evaluation was conducted approximately 2 weeks after implantation according to the timing in the preceding tests. Therefore, no metastatic nodule in the lung was macroscopically observed.

Example 23: In Vivo Antibody Activity Evaluation-Lymphoma

In this Example, the drug efficacy of the anti-FSTL1 antibody was evaluated using mouse lymphoma EL4.

The drug efficacy of the anti-FSTL1 antibody was evaluated according to Examples 17 to 20 using mouse lymphoma EL4, which is a cancer type having enhanced FSTL1 expression.

1. Experiment group (n=5)
1. Mouse lymphoma EL4+control IgG (anti-DNP mAb)
2. Mouse lymphoma EL4+anti-FSTL1 mAb (#6-55)
2. Experimental procedure Day 0: transplantation of tumor cells ($1 \times 10^6$ cells subcutaneously & $1 \times 10^6$ cells intravenously)

Day 3: intraperitoneal administration of the antibody (first dose, corresponding to 200 µg/mouse=10 mg/kg)

Day 6: intraperitoneal administration of the antibody (second dose, corresponding to 200 µg/mouse=10 mg/kg)

Day 15: various immunological assays

3. Index for drug efficacy evaluation

Effects on the growth of subcutaneous tumor (calculation of tumor volume by tumor size measurement): measured 3, 6, and 10 days after tumor implantation (Results)

The results are shown in FIG. 79. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group. It can be concluded that the proven effectiveness for lymphoma, one highly FSTL1-expressing cancer type comparable to breast cancer, is very useful data for developing clinical trials.

Example 24: In Vivo Antibody Activity Evaluation-Melanoma B16-10, Subcutaneous Transplantation In this Example, the drug efficacy of the anti-FSTL1 antibody was evaluated using mouse melanoma B16-F10.

The drug efficacy of the anti-FSTL1 antibody was evaluated in the same test system as in Example 22 according to Examples 17 to 20 except that only subcutaneous transplantation was performed here in order to more clearly evaluate reactivity.
1. Experiment group (n=5)
1. Control IgG (anti-DNP), 10 mg/kg
2. Anti-FSTL1 mAb (#6-55), 1 mg/kg
3. Anti-FSTL1 mAb (#6-55), 3 mg/kg
4. Anti-FSTL1 mAb (#6-55), 10 mg/kg
2. Experimental procedure
Day 0: subcutaneous transplantation of mouse melanoma B16-F10 cells ($1 \times 10^6$ cells)
Day 4: intraperitoneal administration of the antibody (first dose)
Day 8: intraperitoneal administration of the antibody (second dose)
Day 15: various immunological assays
3. Index for drug efficacy evaluation
   Effects on the growth of subcutaneous tumor (calculation of tumor volume by tumor size measurement): measured 6, 10, and 14 days after tumor implantation
   (Results)

The results are shown in FIG. 80. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

Example 25: Treg Induction Inhibitory Activity of Anti-FSTL1 Antibody Using Human Peripheral Blood Cell In this Example, the Treg induction inhibitory activity of the anti-FSTL1 antibody was evaluated using human peripheral blood cells.

Human peripheral blood cells ($1 \times 10^6$ cells) were stimulated using FSTL1 (5 ng/ml), supplemented with the antibody (5 µg/mL), and cultured for 3 days. The percentage of a Foxp3⁻CTLA4⁺ cell fraction (Exp. 1) or a CD4⁺Foxp3⁺CTLA4⁺ cell fraction (Exp. 2) in CD4⁺ T cells was analyzed as Treg cells by flow cytometry. The flow cytometry conditions are as follows.

Blood was collected from a healthy person by the addition of a 1/10 amount of 4% sodium citrate, then layered on Ficoll (specific gravity: 1.090), and centrifuged (1500 rpm, 20 min, room temperature), and a cell fraction present in an intermediate layer was used as "PBMCs". The antibody (5 µg/mL) was added to a system in which these PBMCs ($1 \times 10^6$ cells) were cultured for 3 days under stimulation with FSTL1 (5 ng/ml) in a 24-well plate. PBMCs recovered from the culture system were incubated at 4° C. for 1 hour using an anti-CD4 antibody (BD Pharmingen/Becton, Dickinson and Company), an anti-CD25 antibody (BD Pharmingen/Becton, Dickinson and Company), and an anti-FoxP3 antibody (eBioscience). Then, the percentage of a Foxp3+ CTLA4+ cell fraction (Exp. 1) or a CD4⁺Foxp3⁺CTLA4⁺ cell fraction (Exp. 2) in CD4+ T cells contained therein was analyzed as Treg cells using a flow cytometer FACScan (Becton, Dickinson and Company).

FIG. 81 summarizes these data and results in a table. The double circle, the circle, and the triangle depict statistical significance and represent 30% or more decrease, 10% to 30% decrease, and less than 10% decrease, respectively. The cross mark represents the absence of statistically significant difference. The results revealed that Tregs remarkably increase in number by stimulation with FSTL1, as with TGFb, etc., and this is significantly suppressed by the addition of antibody #6-55 of the present invention (the difference of Exp. 1 from Exp. 2 or 3 is based on difference in peripheral blood donor). On the other hand, a known antibody R&D antibody (R&D Systems, Inc., Cat. No. MAB1694, clone 229007) hardly exhibited inhibition. Here, the superiority of antibody #6-55 of the present invention was also confirmed again. These results indicated that antibody #6-55 of the present invention can remarkably inhibit Treg induction caused by FSTL1.

Example 26: Influence of Anti-FSTL1 Antibody on Proliferative Capacity and Invasive Capacity of Various Human Tumor Cells, Etc.

In this Example, the influence of the anti-FSTL1 antibody on the proliferative capacity and invasive capacity of various human tumor cells, the action of the anti-FSTL1 antibody under FSTL1 stimulation, and the action of the anti-FSTL1 antibody on cells forced to express Snail were examined.

Specifically, the influence of the anti-FSTL1 antibody on proliferative capacity and invasive capacity was studied using various human tumor cells, regardless of the presence or absence of the expression of Snail or FSTL1. Specifically, the anti-FSTL1 antibody (#6-55, 5 µg/ml) or a control antibody (aHema: mouse chimeric anti-hemagglutinin antibody, 5 µg/ml) was added to systems in which a pancreatic cancer cell line Pancl (ATCC # CRL-1469), Pancl-snail+ which is a Pancl cell line forced to express Snail, a pancreatic cancer cell line MIAPaCa (ATCC # CRL-1420), a bone metastatic breast cancer cell line MDA231 (ATCC # HTB-26), and a melanoma cell line Hs294T (ATCC # HTB-140) were each cultured at $1 \times 10^5$ cells. After culture for 3 days, the number of cells per culture system was counted to evaluate the proliferative capacity of the cells. The cells ($5 \times 10^4$ cells) after the counting were further inoculated to Matrigel-coated transwell chamber (Corning Inc. #354480) and cultured for 4 hours. Then, the membranes were removed, and stained and fixed with Crystal Violet fixative. Then, the number of cells that permeated the membranes was counted under a microscope to evaluate the invasive capacity of the cells. As a result, both proliferative capacity and invasive capacity were strongly suppressed, particularly, in a highly metastatic tumor cell line highly expressing Snail. This indicated that the anti-FSTL1 antibody acts particularly on tumor cells highly expressing FSTL1 and having EMT (FIG. 82A).

(Action of Anti-FSTL1 Antibody Under FSTL1 Stimulation)

Next, in order to examine how surrounding tumor cells were changed in a cancer microenvironment by receiving FSTL1 produced by Snail/FSTL1-expressing cells, and how the anti-FSTL1 antibody acts thereon, a human pancreatic cancer cell line Panc1 confirmed to express Snail or FSTL1 only slightly was stimulated with FSTL1 for 3 days. The anti-FSTL1 antibody (#6-55, 5 µg/ml) or a control antibody (aHema, 5 µg/ml) was added to this culture system, and subsequent change in cell function was analyzed in the same way as in the preceding paragraph. As a result, as previously reported in the paper (Cancer Res; 73 (20); 6185-93, 2013), FSTL1 had little influence or contribution on or to tumor growth, whereas the cell growth was reduced by the addition of the anti-FSTL1 antibody together with FSTL1. The paper also reports that FSTL1 enhances invasive capacity. It was revealed that the action thereof is canceled (FIG. 82B).

(Action of Anti-FSTL1 Antibody on Cell Forced to Express Snail)

Cell invasion was evaluated in the presence of the anti-FSTL1 antibody (#6-55, 5 µg/ml) or a control antibody (aHema, 5 µg/ml) in a chamber using Panc1-snail+, a cell line forced to express Snail, instead of the FSTL1-stimulated tumor cells of the preceding paragraph. The results are very similar to the results of the preceding paragraph, and suppressive activity was able to be confirmed in 6-55 (FIG. 82C)).

In this Example, Panc1-snail+ cells were cultured for 3 days in the presence of the added antibody. Then, the expression of CCR2 and RANKL among molecules known as bone metastasis markers was analyzed by flow cytometry. As a result, both CCR2 and RANKL were strongly suppressed by the anti-FSTL1 antibody. The anti-FSTL1 antibody presumably has inhibitory activity against cell invasion (FIG. 82D).

Example 27: MSC Induction Inhibition Test Using Mouse Bone Marrow Cell

In this Example, the inhibitory activity of the anti-FSTL1 antibody was confirmed in an experimental system of mesenchymal stem cell induction while a FSTL1 inhibitory effect on MSC expansion induced not only by FSTL1 but by Snail+ tumor cells was also evaluated. For specific operation, each antibody (10 µg/mL) was added to systems in which C57/BL/6 mouse-derived bone marrow cells were stimulated with FSTL1 (20 ng/mL) or a culture supernatant of tumor cells. After culture for 8 days under stimulation, cell fraction CD45(−) cells (MSCs) containing MSCs at a high rate and CD45(−)CD146(+)ALCAM(+) cells (sMSCs) increasing in number in association with cancer metastasis were analyzed by flow cytometry in the same way as in Example 14, and the number of cells per culture system was counted. In this Example, mouse immunoglobulin manufactured by BioLegend, Inc. (#401408, Cone MG1-45) was used as a control antibody.

The results are shown in FIG. 83. As shown in FIG. 83A, in the MSC induction inhibition test of this Example, #7, #10, #13, and #33 exhibited a strong inhibitory effect equivalent to or higher than that of #6-55 in flow cytometry analysis. As a result, #7, #10, and #33 exhibited high MSC induction inhibitory activity equivalent to or higher than that of #6-55, and reproducibility was able to be confirmed in these 3 clones.

(Influence on MSC Expansion Induced by Tumor Cell)

In this Example, whether or not the anti-FSTL1 antibody could inhibit MSC expansion induced by a culture supernatant of Snail+ tumor cells was evaluated in a MSC induction system using bone marrow cells. C57/BL/6 mouse-derived bone marrow cells were supplemented with the culture supernatant of Snail+ tumor cells and each antibody (10 µg/mL) and cultured for 8 days under stimulation. Then, the following 2 cell groups were analyzed by flow cytometry.
1) General cell fraction "CD45(−) cells" containing MSCs at a high rate
2) "CD45(−)ALCAM(+)CD271(+) cells (=sMSCs)" increasing in number in association with cancer metastasis Formed sphere colonies were classified into large colonies each formed by 50 or more cells and small colonies each formed by 50 or less cells, and observed under a microscope on culture day 8. As a result, as shown in FIGS. 83B to 83D, the induction of MSCs and sMSCs was remarkably inhibited, and the formation of sphere colonies exhibiting the ability to self-renew, which typifies the nature of stem cells, was also strongly suppressed. This suggested the possibility that the FSTL1 antibody exerts an antitumor effect in vivo by inhibiting the induction of MSCs amplified by cancer metastasis.

Example 28: Treg Induction Inhibition Test Using Mouse Spleen Cell

In this Example, newly prepared 3 anti-FSTL1 antibodies differing in epitope were evaluated for their inhibitory activity against Treg induction in a mouse system.

(Material and Method)

In this Example, the experiment was conducted according to Example 17. Specifically, 5 µg/mL of each antibody was added to a system in which C57/BL/6 mouse-derived spleen cells ($2\times10^6$ cells) were stimulated with 5 ng/ml of FSTL1. After culture for 3 days, the percentage (%) of a Foxp3+ CTLA4+ cell fraction in CD4+ T cells was analyzed as Treg cells by flow cytometry. Activity was compared with #6-55 used in the preceding studies.

(Results)

As a result, as shown in FIG. 84, all of the new 3 clones suppressed Treg induction, as compared with the control antibody. Particularly, #7 and #10 exhibited strong suppressive activity equal to or higher than that of #6-55. The Treg induction inhibitory activity of the anti-FSTL1 antibody was also able to be properly confirmed in a human evaluation system using human peripheral blood cells in other Examples. High-impact inhibitory activity was more clearly observed in this mouse evaluation system in this Example. Both #7 and #10 are clones recognizing 205-228 a.a. of FSTL1, indicating that in addition to 148-162 a.a. recognized by #6-55, 205-228 a.a. is also a region important for the activity of FSTL1.

Example 29: Inhibitory Activity of Newly Prepared 3 Anti-FSTL1 Antibodies Differing in Epitope Against Mouse Tumor Activation In this Example, newly prepared 3 anti-FSTL1 antibodies differing in epitope were evaluated for their inhibitory activity against mouse tumor activation.

(Material and Method)

A melanoma cell line F10-snail+ forced to express mouse Snail was supplemented with 5 µg/ml of the anti-FSTL1 antibody or a control antibody (anti-DNP antibody) and cultured for 3 days, and change in the properties of tumor cells was analyzed by various assays. Cell adhesion ability was evaluated by culturing the cells for 2 hours using a fibronectin-coated plate, and then counting the number of cells that adhered to the plate. The invasive capacity of the cells was evaluated by culturing the cells for 4 hours using Matrigel-coated transwell chamber, and then counting the number of cells that permeated the membrane. As for bone metastasis-associated molecule expression, the expression of typical molecular markers CCR2 and RANKL was analyzed by flow cytometry.

(Results)

As shown in FIG. 85, all of the new clone antibodies significantly reduced the expression of CCR2 and RANKL and the invasive capacity of the cells and enhanced cell adhesion, as compared with the control antibody. This means that the cells were converted to epithelial cells. Both activities were substantially equivalent to those of #6-55, and no large difference was seen.

Example 30: In Vivo Drug Efficacy Comparison Between Antibody Drug for Immune Mitigation Already Used Clinically and Anti-FSTL1 Antibody Using Snail+ Tumor Bone Metastasis Model Drugs for immune mitigation such as anti-CTLA4 antibodies have received attention because their administration into tumor can directly ameliorate an immunosuppressed environment in the tumor acting advantageously to cancer cells, and can effectively enhance antitumor immunity (Clin Cancer Res 20: 1747, 2014). Thus, in vivo drug efficacy was compared between antibody drugs for immune mitigation already used clinically and the anti-FSTL1 antibody using Snail+ tumor bone metastasis models.

(Material and Method)
1. Experimental protocol
1-1. Experiment group (n=5)
1. No treatment (0.9% NaCl as a sham)
2. Control mouse IgG (mouse chimeric anti-hemagglutinin antibody, also referred to as aHema)
3. Anti-CTLA4 mAb (Clone 9H10, BioLegend)
4. Anti-PD1 mAb (Clone 9F.1A12, BioLegend)
5. Anti-PDL1 mAb (Clone 10F.9G2, BioLegend)
6. Anti-FSTL1 mAb (#6-55)
7. Naive (no tumors, no treatment)
1-2. Experimental procedure
Day 0: transplantation of GFP+ Snail+B16-F10 tumor cells ($3 \times 10^5$ cells subcutaneously & $2 \times 10^4$ cells intravenously)
Day 5: intratumoral administration of the antibody (corresponding to 200 µg/mouse=10 mg/kg) Day 14: various assays
1-3. Index for drug efficacy evaluation The following was used as an index for drug efficacy evaluation.
Effects on the growth of subcutaneous tumor (calculation of tumor volume by tumor size measurement)
Effects on bone metastasis (amount of GFP+ tumor cells in bone marrow)
Effects on sMSC expansion in bone marrow or the spleen
Influence on the immune system (Procedure)

The tumor volumes of the mice were measured 5, 7, 10, and 14 days after tumor implantation. Methods for evaluating effects on subcutaneous tumor growth, bone metastasis, and sMSC expansion in bone marrow and the spleen were performed in the same way as in Example 17. In order to evaluate influence on the immune system, the contents and numbers of CD4+ T cells ($CD45^+CD3^+CD4^+$; FITC-labeled anti-CD3 antibody, PE-labeled anti-CD4 antibody, and Cy5-labeled anti-CD45 antibody, all from Becton, Dickinson and Company), tumor-specific CD8+ T cells ($CD45^+CD8^+$ tetramer$^+$; FITC-labeled anti-CD8 antibody manufactured by Becton, Dickinson and Company, PE-labeled tetramer manufactured by Medical & Biological Laboratories Co., Ltd. (MBL), and Cy5-labeled anti-CD45 antibody), activated NK cells ($CD45^+NK1.1^+NKG2D^+$; FITC-labeled anti-NK1.1 antibody, PE-labeled anti-NKG2D antibody, and Cy5-labeled anti-CD45 antibody, all from Becton, Dickinson and Company), immunosuppressive T cells ($CD45^+CD4^+FOXP3^+$ Tregs; FITC-labeled anti-Foxp3 antibody manufactured by eBiosciences, PE-labeled anti-CD4 antibody, and Cy5-labeled anti-CD45 antibody), and MDSCs ($CD45^+CD11b^+Gr1+$ MDSCs; FITC-labeled anti-CD11b antibody, PE-labeled anti-Gr1 antibody, and Cy5-labeled anti-CD45 antibody, all from Becton, Dickinson and Company), which were cell groups in charge of antitumor immunity that invaded tumor, were analyzed by flow cytometry. Also, the content and number of highly metastatic tumor cells ($Snail^+CD44^+$ tumors; PE-labeled anti-Snail antibody manufactured by eBiosciences and Cy5-labeled anti-CD44 antibody manufactured by Becton, Dickinson and Company) in subcutaneous tumor was analyzed by flow cytometry.

(Results)

The growth of subcutaneous tumor was significantly suppressed in all of the treatment groups compared with the control antibody administration group, and no significant difference was confirmed among the treatment groups (FIG. 86-1). However, bone metastasis and MSC induction in bone marrow and the spleen were significantly suppressed by the FSTL1 antibody, whereas the CTLA4 antibody and the PDL1 antibody rather enhanced bone metastasis, and the PDL1 antibody did not inhibit MSC induction in bone marrow (FIG. 86-1). As a result of culturing bone marrow cells, the properties of tumor cells present therein differ between both groups. A large number of sphere colonies were formed in the CTLA4 antibody administration group, whereas strong adhesive properties were exhibited in the PDL1 antibody administration group.

On the other hand, as a result of analyzing immunocyte groups (TILs) that received the antibody and invaded subcutaneous tumor, a large number of CD4+ T cells, tumor-specific CD8+ T cells, and activated NK cells invaded tumor in all of the treatment groups (FIG. 86-2). Particularly, these antitumor effector cell groups were found to exceedingly remarkably increase in number by the intratumoral administration of the CTLA4 antibody. Interestingly, a larger number of activated NK cells, which have neither received attention nor been analyzed so far, than the number of tumor-specific CD8+ T cells invaded tumor in the FSTL1 antibody group, as with this CTLA4 antibody group (FIG. 86-2). NK cells are major effector cells of the natural immune system, as with MSC, and have also been reported as cells most susceptible to a suppressive effect by MSCs. Thus, the number or functions of NK cells were presumably improved or enhanced drastically because MSCs drastically decreased in number by the administration of the FSTL1 antibody.

As mentioned above, the antitumor effector cell groups increased in number in all of the treatment groups. Referring to the immunosuppressive cell groups, Tregs or MDSCs rather increased in number in the tumor of the existing antibody drug administration groups. Particularly, the MDSC expansion was markedly seen in the CTLA4 antibody administration group and the PDL1 antibody administration group (FIG. 86-3). Also, the CTLA4 antibody was unable to suppress Treg expansion in the spleen, and CD8+ Tregs increased in number (FIG. 86-4). This may be a rebounding effect after a lapse of days after administration, or a feedback phenomenon in which other immunosuppressive cell groups attempted to compensate for a part where CD4+ Tregs decreased in number. In an intratumoral environment, it is possible that tumor cells are stimulated by, for example, cytokines released by immunocytes that have invaded the environment, to induce EMT, etc. Therefore, change in tumor cells was also confirmed. First, the expression of main EMT marker Snail/CD44 was analyzed. As a result, the original tumor cells used in transplantation were Snail+CD44+, whereas a subpopulation fraction with the enhanced expression intensity of these markers was seen in tumor cells separated from subcutaneous tumor, demonstrating that EMT was rather promoted by treatment (FIG. 86-3). This de novo EMT was particularly markedly seen in the CTLA4 antibody administration group and the PDL1 antibody administration group in which MDSCs increased in number and bone metastasis was also aggravated. As seen from these results, the CTLA4 antibody and the PDL1 antibody were certainly able to recruit antitumor immunity-enhancing members into tumor to suppress tumor growth, but were unable to suppress the expansion of immunosuppressive cell groups, de novo EMT in tumor cells, etc. Therefore, systemic antitumor immunity was not ameliorated. As a result, presumably, bone metastasis was unable to be sufficiently inhibited. On the other hand, no major weak point was seen in data on the PD1 antibody. Particularly, the volume of bone metastasis or the amount of sMSCs is probably attributed to the very drastically decreased number of bone marrow cells. In other words, when the bone marrow cells of the PD1 antibody administration group were cultured, a large number of tumor cells formed colonies, as with the CTLA4 antibody administration group. In actuality, bone metastasis was probably rather aggravated, and tumor cells presumably accumulated in large amounts or grew excessively in a bone environment so that the growth of bone marrow cells was suppressed to drastically decrease the number of cells. The CTLA4 antibody was found to effectively recruit antitumor effector cells into tumor in this intratumoral administration compared with systemic administration. On the other hand, the FSTL1 antibody has a high effect of suppressing inferior parts, but does not have a much high effect of recruiting antitumor effector cells.

Example 31: Mouse Lung Cancer Model

In this Example, drug efficacy was evaluated using mouse lung cancer models in anticipation of the development of the anti-FSTL1 antibody as a therapeutic drug for lung cancer.
(Material and Method)
Experimental protocol
Experiment group (n=5)
1. Isotyoe mouse IgG (aHema)
2. Anti-FSTL1 mAb (#6-55)
3. Normal mice
1-2. Experimental procedure
Day 0: transplantation of mouse lung cancer 3LL cells ($1 \times 10^6$ cells subcutaneously & $5 \times 10^5$ cells intravenously)
Day 3: intraperitoneal administration of the antibody (first dose, corresponding to 200 μg/mouse=10 mg/kg)
Day 7: intraperitoneal administration of the antibody (second dose, corresponding to 200 μg/mouse=10 mg/kg)
Day 14: various immunological assays 1-3. Index for drug efficacy evaluation
Effects on subcutaneous tumor growth (calculation of tumor volume by tumor size measurement)
Ameliorating effect on mouse emaciation (measurement of mouse body weight)
Effects on MSC expansion (CD45− cells in bone marrow or the spleen)
Influence on immune response, etc.
(Procedure)
Subcutaneous tumor growth was measured 3, 5, 7, 10, and 14 days after implantation. Body weights, effects on MSC expansion, and influence on immune response were measured on day 14 in the same way as in Examples described above.
(Results)
As shown in FIG. 87, subcutaneous tumor growth was strongly suppressed by the administration of the anti-FSTL1 antibody, as compared with the control antibody administration group, and tumor disappeared in two out of the five mice. In this model, tumor metastasis to any organ was not macroscopically observed. 14 days after tumor implantation, the mice were too emaciated to walk, as with the bone metastasis models used in the preceding tests, even though at an early stage after tumor implantation. However, weight loss, emaciation, fluffing or the like was not observed in the anti-FSTL1 antibody administration group, and all of the mice were fine.

On the other hand, various immunocytes including MSCs, Tregs, and MDSCs were analyzed as to tumor-infiltrating cells, bone marrow cells, and spleen cells. However, large change was seen in only CD45-ALCAM+ cells which are cancer metastasis-associated sMSCs that became a focus of attention in the bone metastasis models. Although this model was confirmed to cause no bone metastasis, sMSCs increased in number only in bone marrow and decreased in number by the administration of the anti-FSTL1 antibody. 3LL cells were also found to highly express Snail, which presumably incurred sMSC expansion.

These results demonstrated again that FSTL1 inhibitory treatment is effective for cancer types, for example, 3LL cancer, having a common trait, such as "Snail" or "sMSCs". It is expected that lung cancer can also be a cancer type targeted by FSTL1 antibody administration in clinical treatment.

Example 32: Evaluation of In Vivo Drug Efficacy of Each Anti-FSTL1 Antibody Clone In this Example, 4 novel antibody clones confirmed to have effectiveness in the in vitro screening of drug efficacy (#7, #10, #13, and #33) were comparatively evaluated for their in vivo therapeutic effects using, as a positive control, #6-55 used in the preceding tests.
(Material and Method)
Experimental protocol
Experiment group (n=5)
Control IgG (anti-DNP mAb)
6-55
7
10
13
33
1-2. Experimental procedure
Day 0: transplantation of GFP+F10-snail+ tumor cells ($3 \times 10^5$ cells subcutaneously & $2 \times 10^4$ cells intravenously)
Day 4: intraperitoneal administration of the antibody (first dose, 10 mg/kg)

Day 7: intraperitoneal administration of the antibody (second dose, 10 mg/kg)
1-3. Index for drug efficacy evaluation
 Suppression of subcutaneous tumor growth
 Extension of mouse survival period
 (Procedure)
 Subcutaneous tumor was measured 4, 7, 10, 14, 17, 20, and 23 days after tumor cell transplantation.
 (Results)
 As shown in FIG. 88, all of the clones except for #13 exhibited statistically significant suppressive activity, as with #6-55, against subcutaneous tumor growth, as compared with the control antibody administration group, and no significant difference from #6-55 was seen. On the other hand, as shown in FIG. 89 as to the mouse survival period, all of the clones exhibited a statistically significant life-prolonging effect, as with #6-55, as compared with the control antibody administration group. Particularly, #10 and #33 exhibited therapeutic effects equal to or higher than those of #6-55. For #6-55, statistical significance is indicated at the level of p<0.001 of day 12 even in a test conducted at n=10. Hereinafter, the activity rank of each clone summarized on the basis of P values is shown.
Subcutaneous tumor growth suppressive effect:
7=#10>#6-55>#33>#13
Mouse life-prolonging effect:
33=#10>#6-55>#13>#7
 The comprehensive evaluation of these results indicated the possibility that "#10" has high antitumor activity exceeding that of #6-55.
 While a wide range of immunocytes, i.e., CD4+ cells, CD8+ cells, and NK cells, participate in antitumor immune response caused by the inhibition of FSTL1, particularly, the CD8+ cells and the NK cells, which exhibit cytotoxic activity, were also confirmed to play an essential role therein (data not shown). In general immunotherapy, antitumor effector cells are typically CD8+ T cells. NK is often regarded as a cell group of low importance that is involved in only the early stage of carcinogenesis. Rather, it has been shown that, for example, therapeutic effects are further enhanced by the removal of CD4+ T cells including Tregs or the like. On the other hand, in the FSTL1 inhibitory treatment of the present invention, various immunocytes including CD8+ cells are recruited to exert an antitumor effect. This is probably because FSTL1 and MSCs amplified by the action of FSTL1 are most upstream key factors in a cancer-associated abnormal immune mechanism, and the inhibition of FSTL1 converted MSCs as well as their various negatively controlled downstream immune responses toward antitumor ones. In other words, the original concept for development was able to be reconfirmed, and the anti-FSTL1 antibody of the present invention differs largely in the mechanism of action from conventional immunomodifying drugs and is expected to be able to serve as a novel therapeutic drug for cancer that can thoroughly improve and appropriately activate the whole host immunity.
 Specifically, the inhibition of FSTL1 is presumed to inhibit the differentiation induction of MSCs and inhibit immunosuppressive cell groups (MDSCs and Tregs), thereby activating antitumor immunocyte groups. In this Example, feasibility up to the final stage was confirmed, and it is expected that a suppressor attains effects similar to those generally exhibited by an antibody, by suppressing FSTL1.

Example 33: Characterization of Mouse Chimera

In this Example, the affinity of the produced mouse chimeric antibodies for a human FSTL1 antigen was measured.

(Material and Method)
 The mouse chimeric antibodies were immobilized onto Sensor Chip CM5 (GE Healthcare Japan Corp., BR-1005-30) using Mouse Antibody Capture Kit (GE Healthcare Japan Corp., BR-1008-38), and their affinity for human FSTL1 was calculated using Biacore T-200 (GE Healthcare Japan Corp.).
(Results)
 First, the exhaustive activity comparison of the obtained antibodies was conducted with the human FSTL1 concentration fixed to 10 µg/ml (Table 33-1, FIG. 90).
 The ordinate of FIG. 90 shows the antigen binding amounts of the antibodies. The abscissa shows the antigen dissociation amounts of the antibodies. A higher antigen binding amount and a lower dissociation amount suggest affinity (position closer to the upper left of the figure means higher affinity). Next, the $K_D$ values of clone #6-55, #7-34, and #13 presumed to have high affinity in FIG. 90 were calculated with the antigen concentration adjusted to 0 to 20 µg/ml (Table 35-2). As a result, clone #6-55, #7-34, and #13 as well as #7, #10, #33, and the like were also found to have strong affinity in an assay system using surface plasmon resonance.
 (Table 33-1) Antigen binding amount and dissociation amount of mouse chimeric antibody

TABLE 3-33-1

| Clone No. | Binding amount (RU) | Dissociation amount (RU) |
|---|---|---|
| #5-2 | 9.2 | 7.1 |
| #5-3 | 11 | 8.8 |
| #5-8 | 6.7 | 3.4 |
| #5-10 | 9.8 | 12.1 |
| #5-43 | 7 | 3.1 |
| #6-55 | 11 | 1.5 |
| #7-34 | 14.2 | 2.5 |
| #8-1 | 11.1 | 12.3 |
| #8-4 | 11.6 | 6.2 |
| #8-7 | 12.8 | 11.8 |
| #8-8 | 8 | 4.7 |
| #7 | 11.9 | 5.4 |
| #10 | 11.7 | 6 |
| #13 | 8.7 | 0.2 |
| #33 | 10.9 | 4.1 |

(Table 33-2) $K_D$ value of mouse chimeric antibody

TABLE 3-33-2

| Clone No. | $K_D$ (M) |
|---|---|
| #6-55 | 2.43 × 10* |
| #7-34 | 1.22 × 10* |
| #13 | 1.12 × 10* |

Example 34: Development and Affinity Measurement of Humanized Antibody

<Affinity of Humanized Antibody: Measurement Using Biacore T-200>
 In this Example, humanized antibodies were developed, and the affinity of the developed antibodies for human FSTL1 was measured.
 (Material and Method)
 Nine IgG1-type humanized antibodies of #6-55 were immobilized onto Sensor Chip CM5 (GE Healthcare Japan Corp., BR-1005-30) using Human Antibody Capture Kit (GE Healthcare Japan Corp., BR-1008-38), and their affinity for human FSTL1 was calculated using Biacore T-200 (GE Healthcare Japan Corp.). The KD values were calculated with the antigen concentration adjusted to 0 to 20 μg/ml (Table 34-1). Among the 9 IgG1-type humanized antibodies of #6-55, a clone composed of a combination "H(2)-L(1)" having a high KD value was selected as a lead antibody.

(Table 34-1) Table. Affinity ($K_D$ value) comparison based on combination of H chain and L chain of humanized 6-55 antibody (IgG1 type)

TABLE 3-34-1

| | h #6-55 | | | | | | | | |
|---|---|---|---|---|---|---|---|---|---|
| | H(1)-L(1) | H(1)-L(2) | H(3)-L(1) | H(3)-L(1) | H(2)-L(1) | H(2)-L(2) | H(1)-L(3) | H(2)-L(3) | H(3)-L(3) |
| KD value (M) | 3.52 × $10^{-8}$ | 2.50 × $10^{-8}$ | 2.67 × $10^{-8}$ | 3.35 × $10^{-8}$ | 6.05 × $10^{-8}$ | 1.13 × $10^{-8}$ | 2.68 × $10^{-8}$ | 4.50 × $10^{-8}$ | 2.49 × $10^{-8}$ |

<Preparation of Humanized Antibody>

On the basis of the report of Matsuda et al., Molecular Immunology 43 (2006) 634-642, a gene was designed such that frame regions present in the H chain and L chain variable regions of clone #6-55 were substituted by human sequences from the chicken sequences. The gene was synthesized. 3 types each of H chains and L chains per clone were designed and synthesized (humanized H chains (1), (2), and (3), and humanized L chains (1), (2), and (3); H chain (1) is also referred to as H(1), H1, etc., and it is understood that all of these terms refer to the same clone; the same holds true for H chain (2), H chain (3), and L chains (1), (2), and (3)). The full-length sequence of the H(1) heavy chain is represented by SEQ ID NOs: 694 and 695 (which represent nucleic acid and amino acid sequences, respectively) for IgG1 type and represented by SEQ ID NOs: 700 and 701 (which represent nucleic acid and amino acid sequences, respectively) for IgG4 type. The full-length sequence of the H(2) heavy chain is represented by SEQ ID NOs: 696 and 697 (which represent nucleic acid and amino acid sequences, respectively) for IgG1 type and represented by SEQ ID NOs: 702 and 703 (which represent nucleic acid and amino acid sequences, respectively) for IgG4 type. The full-length sequence of the H(3) heavy chain is represented by SEQ ID NOs: 698 and 699 (which represent nucleic acid and amino acid sequences, respectively) for IgG1 type and represented by SEQ ID NOs: 704 and 203 (which represent nucleic acid and amino acid sequences, respectively) for IgG4 type. The full-length sequence of the L(1) light chain is represented by SEQ ID NOs: 706 and 707 (which represent nucleic acid and amino acid sequences, respectively). The full-length sequence of the L(2) light chain is represented by SEQ ID NOs: 748 and 749 (which represent nucleic acid and amino acid sequences, respectively). The full-length sequence of the L(3) light chain is represented by SEQ ID NOs: 750 and 751 (which represent nucleic acid and amino acid sequences, respectively). The synthesized variable region genes were amplified by PCR, then treated with restriction enzymes, and transferred to L chain or H chain expression cassette vectors (restriction enzyme-treated vectors) having gene inserts of a chicken antibody leader sequence and a human IgG1 constant region. HEK293 cells were transfected with 9 types in total of combinations of the constructed H chain (1) to (3) and L chain (1) to (3) expression vectors for the clones, and humanized antibodies were purified from culture supernatants using Protein A Sepharose. As a result of conducting ELISA in order to confirm the binding activity of the purified IgG1-type humanized antibodies against human FSTL1, all of the clones were able to be confirmed to have binding activity to a given extent (FIG. 91). Among them, the humanized clone of H(2)-L(1) exhibited a numerical value higher by an order of magnitude as compared with other clones (see Table 34-1). Therefore, this clone was used in the next experiment.

<Binding Activity of Humanized Antibody: ELISA>

The binding activity of the purified antibody of IgG1-type humanized #6-55 H chain (2)+L chain (1) against human FSTL1 and mouse FSTL1 was confirmed by ELISA (FIG. 92). From the results of FIG. 92, it was able to be confirmed that the antibody of the present invention has similar binding activity against human FSTL1 and mouse FSTL1 and retains activity against human FSTL1.

Example 35: Study on Effect Using Mouse Colorectal Cancer Colon26 Lung Metastasis Model In the preceding tests, in vivo drug efficacy was compared between antibody drugs for immune mitigation already used clinically and the FSTL1 antibody using Snail+ tumor bone metastasis models. This time, similar study was conducted using different tumor models, i.e., mouse colorectal cancer Colon26 lung metastasis models, for the purpose of confirming the drug efficacy and versatility.

(Experiment Schedule)
Day 0: transplantation of Colon26 tumor cells (5×$10^5$ cells/ml subcutaneously & 5×$10^5$ cells/ml intravenously)
Day 5: intraperitoneal administration of the antibody (first dose, corresponding to 200 μg/mouse=10 mg/kg)
Day 8: intraperitoneal administration of the antibody (second dose, corresponding to 200 μg/mouse=10 mg/kg)
Experiment. Drug efficacy comparison with existing antibody drug for mitigation of immunosuppression
1. Experiment group (n=5)
Control mouse IgG (aDNP)
2. Control rat IgG (R&D)
3. Anti-FSTL1 mAb (#6-55)
4. Anti-CTLA4 mAb (Clone 9H10, BioLegend)
5. Anti-PD1 mAb (Clone 29F.1A12, BioLegend)
6. Anti-PD-L1 mAb (Clone 10F.9G2, BioLegend)

(2. Results & discussion)

The growth of subcutaneous tumor was significantly suppressed in all of the treatment groups compared with the control antibody administration group, and no significant difference was confirmed among the treatment groups (FIG. 93). However, unlike the case of the bone metastasis models, tumor growth was strongly suppressed over a long period in all of the mice in the PD-L1 antibody administration group, and the effects of the CTLA4 antibody were also accordingly seen strongly with no superiority of the FSTL1 antibody confirmed. On the other hand, no significant difference in mouse survival period was confirmed among these 3 groups. A significant extending effect was found, as compared with the control antibody administration group. This is presumably because equivalent suppressive effects on lung metastasis were exhibited. As for the PD1 antibody, as in the case of the bone metastasis models, the growth of subcutaneous tumor was significantly suppressed, and the mouse survival period did not differ largely from that of the control antibody administration group and was extended only slightly. This is presumably because lung metastasis was unable to be suppressed. These results revealed that in the Colon26 lung metastasis models, the FSTL1 antibody exhibits no superiority, but has at least activity equivalent to that of the PD-L1 antibody or the CTLA4 antibody.

(Results & Discussion)

In this tumor model, as shown in experiment 1, the CTLA4 antibody also exhibited high antitumor activity.

Example 36: Study on Effect Brought about by Combined Use with Anti-CTLA4 Antibody Using CT26-Transplanted Model Example 35 (In vivo report—11) reported that in the Colon26 lung metastasis models, the anti-FSTL1 antibody exhibits no superiority, but exhibits antitumor activity equivalent to that of the anti-CTLA4 antibody or the anti-PD-L1 antibody. It was also found in Example 35 that unlike the case of the bone metastasis models, the anti-CTLA4 antibody is well effective in the Colon26-transplanted lung metastasis models. Therefore, synergistic effects of the anti-FSTL1 antibody and the anti-CTLA4 antibody were also expected. Hence, effects brought about by the combined use were evaluated this time.

1. Experiment group (n=5)
G1. Mouse IgG control antibody
G2. Anti-FSTL1 antibody
G3. Anti-CTLA4 antibody
G4. Combination 2.
2. Experiment schedule
Day 0: transplantation of CT26 tumor cells ($1 \times 10^6$ cells/ml subcutaneously & $5 \times 10^5$ cells/ml intravenously)
Days 4 & 7: intraperitoneal administration of the antibody×2
   Mouse IgG control antibody (anti-DNP antibody):10 mg/kg×2
   Anti-FSTL1 antibody (#6-55): 5 mg/kg×2
   Anti-CTLA4 antibody (clone 9H10, BioLegend, Inc.): 5 mg/kg×2
   Criteria for determining antitumor effects: subcutaneous tumor growth suppressive effect and extension of mouse survival period
3. Results & Discussion The anti-CTLA4 antibody exhibited a high antitumor effect at a level equal to or greater than the results of the preceding experiment using models having a transplant of Colon26 cells with a high degree of malignancy, as compared with CT26, and subcutaneous tumor disappeared in two out of the five mice. However, these mice also died later, probably, due to lung metastasis. On the other hand, when the anti-FSTL1 antibody was used in combination with the anti-CTLA4 antibody, subcutaneous tumor disappeared in all of the five mice, which survived in a favorable condition over a long period without fluffing and weight loss. All of the cases seemed to be cured. These results indicated that, depending on a cancer type (or difference in FSTL1/DIP2A expression in cancer cells), FSTL1 inhibitory therapeutic effects can also be synergistically enhanced by inhibiting CTLA4.

The present invention is illustrated above by using the preferred embodiments of the present invention. However, it is understood that the scope of the present invention should be interpreted only by claims. It is understood that the contents of patents, patent applications, and literatures cited herein are incorporated herein by reference similarly to the specific description of the contents themselves in the present specification.

INDUSTRIAL APPLICABILITY

The present invention provides prophylactic and therapeutic agent for cancer and techniques of suppressing metastasis, particularly, bone metastasis, by the mitigation of immune defect such as immunosuppression. Particularly, the present invention provides techniques available in industry (reagents, pharmaceutical industry, etc.) involved in techniques related to cancer treatment and prevention, by means of effects brought about by combined use which exerts unexpectedly remarkable effects.

[Free Text of Sequence Listing]
SEQ ID NO: 503: Nucleic acid sequence of human FSTL1
SEQ ID NO: 504: Amino acid sequence of human FSTL1
SEQ ID NO: 505: Nucleic acid sequence of mouse FSTL1
SEQ ID NO: 506: Amino acid sequence of mouse FSTL1
SEQ ID NO: 507: Nucleic acid sequence of the light chain variable region of antibody clone #5-2
SEQ ID NO: 508: Amino acid sequence of the light chain variable region of antibody clone #5-2
SEQ ID NO: 509: Nucleic acid sequence of the heavy chain variable region of antibody clone #5-2
SEQ ID NO: 510: Amino acid sequence of the heavy chain variable region of antibody clone #5-2
SEQ ID NO: 511: Nucleic acid sequence of the light chain variable region of antibody clone #5-3
SEQ ID NO: 512: Amino acid sequence of the light chain variable region of antibody clone #5-3
SEQ ID NO: 513: Nucleic acid sequence of the heavy chain variable region of antibody clone #5-3
SEQ ID NO: 514: Amino acid sequence of the heavy chain variable region of antibody clone #5-3
SEQ ID NO: 515: Nucleic acid sequence of the light chain variable region of antibody clone #5-8
SEQ ID NO: 516: Amino acid sequence of the light chain variable region of antibody clone #5-8
SEQ ID NO: 517: Nucleic acid sequence of the heavy chain variable region of antibody clone #5-8
SEQ ID NO: 518: Amino acid sequence of the heavy chain variable region of antibody clone #5-8
SEQ ID NO: 519: Nucleic acid sequence of the light chain variable region of antibody clone #5-10
SEQ ID NO: 520: Amino acid sequence of the light chain variable region of antibody clone #5-10
SEQ ID NO: 521: Nucleic acid sequence of the heavy chain variable region of antibody clone #5-10
SEQ ID NO: 522: Amino acid sequence of the heavy chain variable region of antibody clone #5-10
SEQ ID NO: 523: Nucleic acid sequence of the light chain variable region of antibody clone #5-43
SEQ ID NO: 524: Amino acid sequence of the light chain variable region of antibody clone #5-43
SEQ ID NO: 525: Nucleic acid sequence of the heavy chain variable region of antibody clone #5-43
SEQ ID NO: 526: Amino acid sequence of the heavy chain variable region of antibody clone #5-43
SEQ ID NO: 527: Nucleic acid sequence of the light chain variable region of antibody clone #6-55
SEQ ID NO: 528: Amino acid sequence of the light chain variable region of antibody clone #6-55
SEQ ID NO: 529: Nucleic acid sequence of the heavy chain variable region of antibody clone #6-55
SEQ ID NO: 530: Amino acid sequence of the heavy chain variable region of antibody clone #6-55
SEQ ID NO: 531: Nucleic acid sequence of the light chain variable region of antibody clone #7-34
SEQ ID NO: 532: Amino acid sequence of the light chain variable region of antibody clone #7-34
SEQ ID NO: 533: Nucleic acid sequence of the heavy chain variable region of antibody clone #7-34
SEQ ID NO: 534: Amino acid sequence of the heavy chain variable region of antibody clone #7-34

SEQ ID NO: 535: Nucleic acid sequence of the light chain variable region of antibody clone #8-1
SEQ ID NO: 536: Amino acid sequence of the light chain variable region of antibody clone #8-1
SEQ ID NO: 537: Nucleic acid sequence of the heavy chain variable region of antibody clone #8-1
SEQ ID NO: 538: Amino acid sequence of the heavy chain variable region of antibody clone #8-1
SEQ ID NO: 539: Nucleic acid sequence of the light chain variable region of antibody clone #8-4
SEQ ID NO: 540: Amino acid sequence of the light chain variable region of antibody clone #8-4
SEQ ID NO: 541: Nucleic acid sequence of the heavy chain variable region of antibody clone #8-4
SEQ ID NO: 542: Amino acid sequence of the heavy chain variable region of antibody clone #8-4
SEQ ID NO: 543: Nucleic acid sequence of the light chain variable region of antibody clone #8-7
SEQ ID NO: 544: Amino acid sequence of the light chain variable region of antibody clone #8-7
SEQ ID NO: 545: Nucleic acid sequence of the heavy chain variable region of antibody clone #8-7
SEQ ID NO: 546: Amino acid sequence of the heavy chain variable region of antibody clone #8-7
SEQ ID NO: 547: Nucleic acid sequence of the light chain variable region of antibody clone #8-8
SEQ ID NO: 548: Amino acid sequence of the light chain variable region of antibody clone #8-8
SEQ ID NO: 549: Nucleic acid sequence of the heavy chain variable region of antibody clone #8-8
SEQ ID NO: 550: Amino acid sequence of the heavy chain variable region of antibody clone #8-8
SEQ ID NO: 551: Nucleic acid sequence of the light chain variable region of antibody clone #7
SEQ ID NO: 552: Amino acid sequence of the light chain variable region of antibody clone #7
SEQ ID NO: 553: Nucleic acid sequence of the heavy chain variable region of antibody clone #7
SEQ ID NO: 554: Amino acid sequence of the heavy chain variable region of antibody clone #7
SEQ ID NO: 555: Nucleic acid sequence of the light chain variable region of antibody clone #10
SEQ ID NO: 556: Amino acid sequence of the light chain variable region of antibody clone #10
SEQ ID NO: 557: Nucleic acid sequence of the heavy chain variable region of antibody clone #10
SEQ ID NO: 558: Amino acid sequence of the heavy chain variable region of antibody clone #10
SEQ ID NO: 559: Nucleic acid sequence of the light chain variable region of antibody clone #13
SEQ ID NO: 560: Amino acid sequence of the light chain variable region of antibody clone #13
SEQ ID NO: 561: Nucleic acid sequence of the heavy chain variable region of antibody clone #13
SEQ ID NO: 562: Amino acid sequence of the heavy chain variable region of antibody clone #13
SEQ ID NO: 563: Nucleic acid sequence of the light chain variable region of antibody clone #22
SEQ ID NO: 564: Amino acid sequence of the light chain variable region of antibody clone #22
SEQ ID NO: 565: Nucleic acid sequence of the heavy chain variable region of antibody clone #22
SEQ ID NO: 566: Amino acid sequence of the heavy chain variable region of antibody clone #22
SEQ ID NO: 567: Nucleic acid sequence of the light chain variable region of antibody clone #33
SEQ ID NO: 568: Amino acid sequence of the light chain variable region of antibody clone #33
SEQ ID NO: 569: Nucleic acid sequence of the heavy chain variable region of antibody clone #33
SEQ ID NO: 570: Amino acid sequence of the heavy chain variable region of antibody clone #33
SEQ ID NO: 571: Nucleic acid sequence of FSTL1 used in Examples (human; human FSTL1 gene after codon optimization+sequence with sequences for recombination added at both ends+C-terminally 3×alanine+6×histidine-added sequence)
SEQ ID NO: 572: Amino acid sequence of FSTL1 used in Examples (human; human FSTL1 gene after codon optimization+sequence with sequences for recombination added at both ends+C-terminally 3×alanine+6×histidine-added sequence)
SEQ ID NO: 573: Nucleic acid sequence of FSTL1 used in Examples (mouse; mouse FSTL1 gene after codon optimization+sequence with sequences for recombination added at both ends+C-terminally 3×alanine+6×histidine-added sequence)
SEQ ID NO: 574: Amino acid sequence of FSTL1 used in Examples (mouse; mouse FSTL1 gene after codon optimization+sequence with sequences for recombination (red) added at both ends+C-terminally 3×alanine+6×histidine-added sequence)
SEQ ID NO: 575: MCS sequence
SEQ ID NO: 576: MCS sequence (complementary chain)
SEQ ID NO: 577: Sequence for insertion
SEQ ID NO: 578: Sequence for insertion
SEQ ID NO: 579: Δ21-53 (Forward primer)
SEQ ID NO: 580: Δ21-53 (Reverseprimer)
SEQ ID NO: 581: Δ100-140 (Forward primer)
SEQ ID NO: 582: Δ100-140 (Reverseprimer)
SEQ ID NO: 583: Δ148-170 (Forward primer)
SEQ ID NO: 584: Δ148-170 (Reverseprimer)
SEQ ID NO: 585: Δ181-190 (Forward primer)
SEQ ID NO: 586: Δ181-190 (Reverseprimer)
SEQ ID NO: 587: Δ193-228 (Forward primer)
SEQ ID NO: 588: Δ193-228 (Reverseprimer)
SEQ ID NO: 589: Δ233-289 (Forward primer)
SEQ ID NO: 590: Δ233-289 (Reverseprimer)
SEQ ID NO: 591: Δ148-154 (Forward primer)
SEQ ID NO: 592: Δ148-154 (Reverse primer)
SEQ ID NO: 593: Δ155-162 (Forward primer)
SEQ ID NO: 594: Δ155-162 (Reverse primer)
SEQ ID NO: 595: Δ163-170 (Forward primer)
SEQ ID NO: 596: Δ163-170 (Reverse primer)
SEQ ID NO: 597: Full-length nucleic acid sequence of the light chain of antibody clone #5-2
SEQ ID NO: 598: Full-length amino acid sequence of the light chain of antibody clone #5-2
SEQ ID NO: 599: Full-length nucleic acid sequence of the heavy chain of antibody clone #5-2
SEQ ID NO: 600: Full-length amino acid sequence of the heavy chain of antibody clone #5-2
SEQ ID NO: 601: Full-length nucleic acid sequence of the light chain of antibody clone #5-3
SEQ ID NO: 602: Full-length amino acid sequence of the light chain of antibody clone #5-3
SEQ ID NO: 603: Full-length nucleic acid sequence of the heavy chain of antibody clone #5-3
SEQ ID NO: 604: Full-length amino acid sequence of the heavy chain of antibody clone #5-3
SEQ ID NO: 605: Full-length nucleic acid sequence of the light chain of antibody clone #5-8

SEQ ID NO: 606: Full-length amino acid sequence of the light chain of antibody clone #5-8
SEQ ID NO: 607: Full-length nucleic acid sequence of the heavy chain of antibody clone #5-8
SEQ ID NO: 608: Full-length amino acid sequence of the heavy chain of antibody clone #5-8
SEQ ID NO: 609: Full-length nucleic acid sequence of the light chain of antibody clone #5-10
SEQ ID NO: 610: Full-length amino acid sequence of the light chain of antibody clone #5-10
SEQ ID NO: 611: Full-length nucleic acid sequence of the heavy chain of antibody clone #5-10
SEQ ID NO: 612: Full-length amino acid sequence of the heavy chain of antibody clone #5-10
SEQ ID NO: 613: Full-length nucleic acid sequence of the light chain of antibody clone #5-43
SEQ ID NO: 614: Full-length amino acid sequence of the light chain of antibody clone #5-43
SEQ ID NO: 615: Full-length nucleic acid sequence of the heavy chain of antibody clone #5-43
SEQ ID NO: 616: Full-length amino acid sequence of the heavy chain of antibody clone #5-43
SEQ ID NO: 617: Full-length nucleic acid sequence of the light chain of antibody clone #6-55
SEQ ID NO: 618: Full-length amino acid sequence of the light chain of antibody clone #6-55
SEQ ID NO: 619: Full-length nucleic acid sequence of antibody clone #6-55
SEQ ID NO: 620: Full-length amino acid sequence of antibody clone #6-55
SEQ ID NO: 621: Full-length nucleic acid sequence of the light chain of antibody clone #7-34
SEQ ID NO: 622: Full-length amino acid sequence of the light chain of antibody clone #7-34
SEQ ID NO: 623: Full-length nucleic acid sequence of the heavy chain of antibody clone #7-34
SEQ ID NO: 624: Full-length amino acid sequence of the heavy chain of antibody clone #7-34
SEQ ID NO: 625: Full-length nucleic acid sequence of the light chain of antibody clone #8-1
SEQ ID NO: 626: Full-length amino acid sequence of the light chain of antibody clone #8-1
SEQ ID NO: 627: Full-length nucleic acid sequence of the heavy chain of antibody clone #8-1
SEQ ID NO: 628: Full-length amino acid sequence of the heavy chain of antibody clone #8-1
SEQ ID NO: 629: Full-length nucleic acid sequence of the light chain of antibody clone #8-4
SEQ ID NO: 630: Full-length amino acid sequence of the light chain of antibody clone #8-4
SEQ ID NO: 631: Full-length nucleic acid sequence of the heavy chain of antibody clone #8-4
SEQ ID NO: 632: Full-length amino acid sequence of the heavy chain of antibody clone #8-4
SEQ ID NO: 633: Full-length nucleic acid sequence of the light chain of antibody clone #8-7
SEQ ID NO: 634: Full-length amino acid sequence of the light chain of antibody clone #8-7
SEQ ID NO: 635: Full-length nucleic acid sequence of the heavy chain of antibody clone #8-7
SEQ ID NO: 636: Full-length amino acid sequence of the heavy chain of antibody clone #8-7
SEQ ID NO: 637: Full-length nucleic acid sequence of the light chain of antibody clone #8-8
SEQ ID NO: 638: Full-length amino acid sequence of the light chain of antibody clone #8-8
SEQ ID NO: 639: Full-length nucleic acid sequence of the heavy chain of antibody clone #8-8
SEQ ID NO: 640: Full-length amino acid sequence of the heavy chain of antibody clone #8-8
SEQ ID NO: 641: Full-length nucleic acid sequence of the light chain of antibody clone #7
SEQ ID NO: 642: Full-length amino acid sequence of the light chain of antibody clone #7
SEQ ID NO: 643: Full-length nucleic acid sequence of the heavy chain of antibody clone #7
SEQ ID NO: 644: Full-length amino acid sequence of the heavy chain of antibody clone #7
SEQ ID NO: 645: Full-length nucleic acid sequence of the light chain of antibody clone #10
SEQ ID NO: 646: Full-length amino acid sequence of the light chain of antibody clone #10
SEQ ID NO: 647: Full-length nucleic acid sequence of the heavy chain of antibody clone #10
SEQ ID NO: 648: Full-length amino acid sequence of the heavy chain of antibody clone #10
SEQ ID NO: 649: Full-length nucleic acid sequence of the light chain of antibody clone #13
SEQ ID NO: 650: Full-length amino acid sequence of the light chain of antibody clone #13
SEQ ID NO: 651: Full-length nucleic acid sequence of the heavy chain of antibody clone #13
SEQ ID NO: 652: Full-length amino acid sequence of the heavy chain of antibody clone #13
SEQ ID NO: 653: Full-length nucleic acid sequence of the light chain of antibody clone #22
SEQ ID NO: 654: Full-length amino acid sequence of the light chain of antibody clone #22
SEQ ID NO: 655: Full-length nucleic acid sequence of the heavy chain of antibody clone #22
SEQ ID NO: 656: Full-length amino acid sequence of the heavy chain of antibody clone #22
SEQ ID NO: 657: Full-length nucleic acid sequence of the light chain of antibody clone #33
SEQ ID NO: 658: Full-length amino acid sequence of the light chain of antibody clone #33
SEQ ID NO: 659: Full-length nucleic acid sequence of the heavy chain of antibody clone #33
SEQ ID NO: 660: Full-length amino acid sequence of the heavy chain of antibody clone #33
SEQ ID NO: 661: Amino acid sequence of FSTL1 of Novoprotein
SEQ ID NO: 662: Nucleic acid sequence of framework 1 of the H(1) heavy chain of a humanized sequence
SEQ ID NO: 663: Amino acid sequence of framework 1 of the H(1) heavy chain of the humanized sequence
SEQ ID NO: 664: Nucleic acid sequence of framework 2 of the H(1) heavy chain of the humanized sequence
SEQ ID NO: 665: Amino acid sequence of framework 2 of the H(1) heavy chain of the humanized sequence
SEQ ID NO: 666: Nucleic acid sequence of framework 3 of the H(1) heavy chain of the humanized sequence
SEQ ID NO: 667: Amino acid sequence of framework 3 of the H(1) heavy chain of the humanized sequence
SEQ ID NO: 668: Nucleic acid sequence of framework 4 of the H(1) heavy chain of the humanized sequence
SEQ ID NO: 669: Amino acid sequence of framework 4 of the H(1) heavy chain of the humanized sequence
SEQ ID NO: 670: Nucleic acid sequence of framework 1 of the H(2) heavy chain of a humanized sequence
SEQ ID NO: 671: Amino acid sequence of framework 1 of the H(2) heavy chain of the humanized sequence SEQ ID NO: 672: Nucleic acid sequence of framework 2 of the H(2) heavy chain of the humanized sequence
SEQ ID NO: 673: Amino acid sequence of framework 2 of the H(2) heavy chain of the humanized sequence
SEQ ID NO: 674: Nucleic acid sequence of framework 3 of the H(2) heavy chain of the humanized sequence
SEQ ID NO: 675: Amino acid sequence of framework 3 of the H(2) heavy chain of the humanized sequence
SEQ ID NO: 676: Nucleic acid sequence of framework 4 of the H(2) heavy chain of the humanized sequence
SEQ ID NO: 677: Amino acid sequence of framework 4 of the H(2) heavy chain of the humanized sequence
SEQ ID NO: 678: Nucleic acid sequence of framework 1 of the H(3) heavy chain of a humanized sequence
SEQ ID NO: 679: Amino acid sequence of framework 1 of the H(3) heavy chain of the humanized sequence
SEQ ID NO: 680: Nucleic acid sequence of framework 2 of the H(3) heavy chain of the humanized sequence
SEQ ID NO: 681: Amino acid sequence of framework 2 of the H(3) heavy chain of the humanized sequence
SEQ ID NO: 682: Nucleic acid sequence of framework 3 of the H(3) heavy chain of the humanized sequence
SEQ ID NO: 683: Amino acid sequence of framework 3 of the H(3) heavy chain of the humanized sequence
SEQ ID NO: 684: Nucleic acid sequence of framework 4 of the H(3) heavy chain of the humanized sequence
SEQ ID NO: 685: Amino acid sequence of framework 4 of the H(3) heavy chain of the humanized sequence
SEQ ID NO: 686: Nucleic acid sequence of framework 1 of the L(1) light chain of a humanized sequence
SEQ ID NO: 687: Amino acid sequence of framework 1 of the L(1) light chain of the humanized sequence
SEQ ID NO: 688: Nucleic acid sequence of framework 2 of the L(1) light chain of the humanized sequence
SEQ ID NO: 689: Amino acid sequence of framework 2 of the L(1) light chain of the humanized sequence
SEQ ID NO: 690: Nucleic acid sequence of framework 3 of the L(1) light chain of the humanized sequence
SEQ ID NO: 691: Amino acid sequence of framework 3 of the L(1) light chain of the humanized sequence
SEQ ID NO: 692: Nucleic acid sequence of framework 4 of the L(1) light chain of the humanized sequence
SEQ ID NO: 693: Amino acid sequence of framework 4 of the L(1) light chain of the humanized sequence
SEQ ID NO: 694: Full-length nucleic acid sequence of the IgG1-type H(1) heavy chain of a humanized sequence
SEQ ID NO: 695: Full-length amino acid sequence of the IgG1-type H(1) heavy chain of the humanized sequence
SEQ ID NO: 696: Full-length nucleic acid sequence of the IgG1-type H(2) heavy chain of a humanized sequence
SEQ ID NO: 697: Full-length amino acid sequence of the IgG1-type H(2) heavy chain of the humanized sequence
SEQ ID NO: 698: Full-length nucleic acid sequence of the IgG1-type H(3) heavy chain of a humanized sequence
SEQ ID NO: 699: Full-length amino acid sequence of the IgG1-type H(3) heavy chain of the humanized sequence
SEQ ID NO: 700: Full-length nucleic acid sequence of the IgG4-type H(1) heavy chain of a humanized sequence
SEQ ID NO: 701: Full-length amino acid sequence of the IgG4-type H(1) heavy chain of the humanized sequence
SEQ ID NO: 702: Full-length nucleic acid sequence of the IgG4 H(2) heavy chain of a humanized sequence
SEQ ID NO: 703: Full-length amino acid sequence of the IgG4 H(2) heavy chain of the humanized sequence
SEQ ID NO: 704: Full-length nucleic acid sequence of the IgG4 H(3) heavy chain of a humanized sequence
SEQ ID NO: 705: Full-length amino acid sequence of the IgG4 H(3) heavy chain of the humanized sequence
SEQ ID NO: 706: Full-length nucleic acid sequence of the L(1) light chain of a humanized sequence
SEQ ID NO: 707: Full-length amino acid sequence of the L(1) light chain of a humanized sequence
SEQ ID NO: 708: Amino acid sequence of heavy chain sequence framework 1 of a chicken sequence for reference
SEQ ID NO: 709: Amino acid sequence of heavy chain sequence framework 2 of the chicken sequence for reference
SEQ ID NO: 710: Amino acid sequence of heavy chain sequence framework 3 of the chicken sequence for reference
SEQ ID NO: 711: Amino acid sequence of heavy chain sequence framework 4 of the chicken sequence for reference
SEQ ID NO: 712: Amino acid sequence of light chain sequence framework 1 of the chicken sequence for reference
SEQ ID NO: 713: Amino acid sequence of light chain sequence framework 2 of the chicken sequence for reference
SEQ ID NO: 714: Amino acid sequence of light chain sequence framework 3 of the chicken sequence for reference
SEQ ID NO: 715: Amino acid sequence of light chain sequence framework 4 of the chicken sequence for reference
SEQ ID NO: 716: Alternative amino acid sequence of light chain sequence framework 2 of the chicken sequence for reference
SEQ ID NO: 717: Alternative amino acid sequence of light chain sequence framework 3 of the chicken sequence for reference
SEQ ID NO: 718: Δ193-204 (Forward primer)
SEQ ID NO: 719: Δ193-204 (Reverse primer)
SEQ ID NO: 720: Δ205-216 (Forward primer)
SEQ ID NO: 721: Δ205-216 (Reverse primer)
SEQ ID NO: 722: Δ217-228 (Forward primer)
SEQ ID NO: 723: Δ217-228 (Reverse primer)
SEQ ID NO: 724: Δ233-251 (Forward primer)
SEQ ID NO: 725: Δ233-251 (Reverse primer)
SEQ ID NO: 726: Δ252-270 (Forward primer)
SEQ ID NO: 727: Δ252-270 (Reverse primer)
SEQ ID NO: 728: Δ271-289 (Forward primer)
SEQ ID NO: 729: Δ271-289 (Reverse primer)
SEQ ID NO: 730: Δ48-100 (Forward primer)
SEQ ID NO: 731: Δ48-100 (Reverse primer)
SEQ ID NO: 732: Nucleic acid sequence of framework 1 of the L(2) light chain of a humanized sequence
SEQ ID NO: 733: Amino acid sequence of framework 1 of the L(2) light chain of the humanized sequence
SEQ ID NO: 734: Nucleic acid sequence of framework 2 of the L(2) light chain of the humanized sequence
SEQ ID NO: 735: Amino acid sequence of framework 2 of the L(2) light chain of the humanized sequence
SEQ ID NO: 736: Nucleic acid sequence of framework 3 of the L(2) light chain of the humanized sequence
SEQ ID NO: 737: Amino acid sequence of framework 3 of the L(2) light chain of the humanized sequence
SEQ ID NO: 738: Nucleic acid sequence of framework 4 of the L(2) light chain of the humanized sequence
SEQ ID NO: 739: Amino acid sequence of framework 4 of the L(2) light chain of the humanized sequence
SEQ ID NO: 740: Nucleic acid sequence of framework 1 of the L(3) light chain of humanized sequence
SEQ ID NO: 741: Amino acid sequence of framework 1 of the L(3) light chain of humanized sequence
SEQ ID NO: 742: Nucleic acid sequence of framework 2 of the L(3) light chain of humanized sequence
SEQ ID NO: 743: Amino acid sequence of framework 2 of the L(3) light chain of humanized sequence SEQ ID NO: 744: Nucleic acid sequence of framework 3 of the L(3) light chain of humanized sequence
SEQ ID NO: 745: Amino acid sequence of framework 3 of the L(3) light chain of humanized sequence
SEQ ID NO: 746: Nucleic acid sequence of framework 4 of the L(3) light chain of humanized sequence
SEQ ID NO: 747: Amino acid sequence of framework 4 of the L(3) light chain of humanized sequence
SEQ ID NO: 748: Full-length nucleic acid sequence of the L(2) light chain of the humanized sequence
SEQ ID NO: 749: Full-length amino acid sequence of the L(2) light chain of the humanized sequence
SEQ ID NO: 750: Full-length nucleic acid sequence of the L(3) light chain of the humanized sequence
SEQ ID NO: 751: Full-length amino acid sequence of the L(3) light chain of the humanized sequence
SEQ ID NO: 752: Nucleic acid sequence of human CTLA4
SEQ ID NO: 753: Amino acid sequence of human CTLA4
SEQ ID NO: 754: Nucleic acid sequence of mouse CTLA4
SEQ ID NO: 755: Amino acid sequence of mouse CTLA4
SEQ ID NO: 756: Amino acid sequence of the heavy chain of ipilimumab
SEQ ID NO: 757: Amino acid sequence of the light chain of ipilimumab
<Part 4>

TECHNICAL FIELD

The present invention relates to a combination drug for treatment of malignant tumor, etc.

BACKGROUND ART

Immunosuppression has been known as a cause of aggravation of cancer. The mitigation of immunosuppression reportedly leads to the effective treatment of cancer. Thus, approaches therefor are under development.

Patent Literature 1 has reported molecules associated with the mitigation of immunosuppression. Although FSTL1 has been studied to some extent (Non Patent Literatures 1 and 2), much is still unknown about its functions.

Techniques of the mitigation of immunosuppression are still evolving. Cancer patients have in vivo host immunity, which attempts to attack and eliminate cancer. On the other hand, cancer cells are known to possess a system that attempts to circumvent control of the host immunity. For example, it has been found in vitro and in vivo that immune response to cancer cells is changed by removing regulatory T cells in the presence of the cancer cells (see Non Patent Literature 3=Andaloussi and Lesniak Neuro-Oncology 8, 234-243, 2006). Regulatory T cells increase in number in stomach cancer (see Non Patent Literature 4=Ichihara et al., Clin. Cancer Res. 9, 4404-4408, 2003; and Non Patent Literature 5=Wolf et al., Clin. Cancer Res. 9, 606-612, 2003), rectal cancer (see Non Patent Literature 6=Hicky et al., Semin. Immunol. 11, 125-137, 1999), pancreatic cancer (see Non Patent Literature 7=Liyanage et al., J. Immunol. 169, 2756-2761, 2002; and Non Patent Literature 8=Sasada et al., Cancer 98, 1098-1099, 2003), lung cancer (see Non Patent Literature 9=Woo et al., Cancer Res. 61, 4766-4772, 2001), and glioma (see Non Patent Literature 3=Andaloussi and Lesniak Neuro-Oncology 8, 234-243, 2006), suggesting that the regulatory T cells are involved in the immune escape system of cancer cells. However, the mechanism underlying this is unknown, and the manner in which regulatory T cell-derived cytokines contribute remains a subject of dispute (see Non Patent Literature 3).

Deficiency in regulatory T cells causes serious autoimmune diseases (see Non Patent Literature 10=Sakaguchi et al., Immunol. Rev. 182, 18-32, 2001), suggesting that autoimmunity and cancer immunity have a common mechanism (see Non Patent Literature 11=Turk et al., Immunol. Rev. 188, 122-135, 2002). As mentioned above, regulatory T cells are known to participate not only in the immunosuppression of cancer cells but in exaggerated immune response such as autoimmunity or allergic reaction, through the suppression of immune response (see Non Patent Literature 12=Miyara and Sakaguchi Trends Mol. Med. 13, 108-116, 2007).

Against this backdrop, drugs for mitigation of immunosuppression currently under development are designed to remove some immunosuppressive cell populations, such as regulatory T cells or regulatory dendritic cells, or to inhibit their functions. Therefore, under the present circumstance, these drugs must be used in combination for modifying the whole immune system and are reportedly not much effective in actuality.

CITATION LIST

Patent Literature

[Patent Literature 1] International Publication No. WO2009/028411

Non Patent Literature

[Non Patent Literature 1] Cancer Research 73 (20); 6185-93, 2013
[Non Patent Literature 2] OncoImmunology 2: 11, e26528, 2013
[Non Patent Literature 3] Andaloussi and Lesniak Neuro-Oncology 8, 234-243, 2006
[Non Patent Literature 4] Ichihara et al. Clin.Cancer Res. 9, 4404-4408, 2003
[Non Patent Literature 5] Wolf et al. Clin.Cancer Res. 9, 606-612, 2003
[Non Patent Literature 6] Hicky et al. Semin. Immunol. 11, 125-137, 1999
[Non Patent Literature 7] Liyanage et al. J. Immunol. 169, 2756-2761, 2002
[Non Patent Literature 8] Sasada et al. Cancer 98, 1098-1099, 2003
[Non Patent Literature 9] Woo et al. Cancer Res. 61, 4766-4772, 2001
[Non Patent Literature 10] Sakaguchi et al. Immunol. Rev. 182, 18-32, 2001
[Non Patent Literature 11] Turk et al. Immunol. Rev. 188, 122-135, 2002
[Non Patent Literature 12] Miyara and Sakaguchi Trends Mol. Med. 13, 108-116, 2007

SUMMARY OF INVENTION

Solution to Problem

The present inventors have conducted diligent studies and consequently completed the present invention by finding out that: FSTL1 is a more promising target for the mitigation of immunosuppression; and the inhibition of the activity of FSTL1 is effective against the induction or growth of cancer-associated mesenchymal stem cells (MSCs) inducing immunosuppression considered to be partly responsible for the aggravation of cancer, and further against the acquirement of metastatic properties, particularly, bone metastatic properties, by cancer cells, and is remarkably effective for eliminating cancer. In the present invention, it has been found that FSTL1 can induce MSCs inducing immunosuppressive cells such as regulatory T cells, regulatory dendritic cells, tolerogenic dendritic cells, or myeloid-derived suppressor cells. Hence, it has been found that: upstream inhibition thereof may mitigate the whole mechanism of immunosuppression; and such an inhibitor is available as an effective anticancer agent. Thus, the present invention should receive attention, particularly, from the viewpoint that it is expected that cancer can be eliminated from living bodies more effectively than conventional methods by both "inhibition of MSCs inducing immune defect such as immunosuppression or immunodeficiency" and "inhibition of the metastatic properties of cancer cells". On the basis of these findings, the present inventors have further continued development and completed the present invention by further finding that the combination of an anti-FSTL1 antibody and a chemotherapeutic agent has unexpectedly remarkable therapeutic effects.

Thus, the present invention provides the following:

(1) A combination product of a FSTL1 suppressor and a chemotherapeutic agent.

(2) The combination product according to item 1, wherein the FSTL1 suppressor is each independently selected from the group consisting of an antibody, an antigen binding fragment thereof, a derivative of the antibody or the fragment, a functional equivalent, an antisense nucleic acid, siRNA, an aptamer, and a ribozyme, and a complex thereof.

(3) The combination product according to item 1 or 2, wherein the FSTL1 suppressor is an anti-FSTL1 antibody or a fragment or functional equivalent thereof.

(4) A combination product of an anti-FSTL1 antibody or a fragment or functional equivalent thereof and a chemotherapeutic agent.

(5) The combination product according to any one of items 1 to 4, wherein the chemotherapeutic agent has a function of inhibiting DNA synthesis.

(6) The combination product according to any one of items 1 to 5, wherein the chemotherapeutic agent is at least one selected from the group consisting of an alkylating agent, a nitrosourea agent, an antimetabolite, an anticancer antibiotic, a plant-derived alkaloid, a topoisomerase inhibitor, a hormone therapeutic agent, a hormone antagonist, an aromatase inhibitor, a P glycoprotein inhibitor, and a platinum complex derivative.

(7) The combination product according to any one of items 1 to 6, wherein the chemotherapeutic agent comprises an alkylating agent.

(8) The combination product according to any one of items 1 to 7, wherein the chemotherapeutic agent comprises cyclophosphamide or a derivative thereof.

(9) The combination product according to any one of items 1 to 8, wherein the chemotherapeutic agent comprises cyclophosphamide.

(10) The combination product according to any one of items 3 to 9, wherein the anti-FSTL1 antibody recognizes an epitope in a region selected from the group consisting of amino acid positions 48 to 100, 148 to 162, 193 to 228, and 272 to 289 of SEQ ID NO: 758 (amino acid sequence of human FSTL1).

(11) The combination product according to any one of items 3 to 10, wherein the antibody comprises the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #13 (light chain: SEQ ID NO: 815; heavy chain: SEQ ID NO: 817) and #33 (light chain: SEQ ID NO: 823; heavy chain: SEQ ID NO: 825).

(12) The combination product according to any one of items 3 to 11, wherein the anti-FSTL1 antibody comprises the full-length variable regions of an antibody selected from the group consisting of antibody #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #13 (light chain: SEQ ID NO: 815; heavy chain: SEQ ID NO: 817) and #33 (light chain: SEQ ID NO: 823; heavy chain: SEQ ID NO: 825).

(13) The combination product according to any one of items 3 to 12, wherein the anti-FSTL1 antibody comprises a full-length antibody selected from the group consisting of antibody #6-55 (light chain: SEQ ID NO: 873; heavy chain: SEQ ID NO: 875), #7-34 (light chain: SEQ ID NO: 877; heavy chain: SEQ ID NO: 879), #8-1 (light chain: SEQ ID NO: 881; heavy chain: SEQ ID NO: 883), #7 (light chain: SEQ ID NO: 897; heavy chain: SEQ ID NO: 899), #13 (light chain: SEQ ID NO: 905; heavy chain: SEQ ID NO: 907) and #33 (light chain: SEQ ID NO: 913; heavy chain: SEQ ID NO: 915) or a humanized sequence thereof.

(14) The combination product according to any one of items 3 to 13, wherein the anti-FSTL1 antibody is a humanized antibody.

(15) The combination product according to any one of items 3 to 14, wherein the anti-FSTL1 antibody is a humanized antibody having the H chain FR1, FR2, FR3, and FR4 (SEQ ID NOs: 926, 928, 930, and 932, respectively) and L chain FR1, FR2, FR3, and FR4 (SEQ ID NOs: 942, 944, 946, and 948, respectively) of H(2)-L(1).

(16) A medicament comprising a combination product according to any one of items 1 to 15.

(17) An anticancer agent comprising a combination product according to any one of items 1 to 15.

(18) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising a combination product according to any one of items 1 to 15.

(19) A therapeutic agent for lung cancer, comprising a combination product according to any one of items 1 to 15.

(20) An inhibitor of metastasis of cancer cells, comprising a combination product according to any one of items 1 to 15.

(21) An inhibitor of enhancement of immune defect by mesenchymal stem cells (MSCs), comprising a combination product according to any one of items 1 to 15.

(22) The inhibitor according to item 21, wherein the immune defect includes immunosuppression and immunodeficiency.

(23) The inhibitor according to item 21, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(24) An inhibitor of acquirement and/or enhancement of immune defect activity by or of immune-related cells, comprising a combination product according to any one of items 1 to 15.

(25) The inhibitor according to item 24, wherein the immune defect includes immunosuppression and immunodeficiency.

(26) The inhibitor according to item 24 or 25, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(27) An anticancer agent comprising a FSTL1 suppressor, wherein the FSTL1 suppressor is administered in combination with a chemotherapeutic agent.

(28) An anticancer agent comprising an anti-FSTL1 antibody or a fragment or functional equivalent thereof, wherein the anti-FSTL1 antibody or the fragment or functional equivalent thereof is administered in combination with a chemotherapeutic agent.

(29) An anticancer agent comprising a chemotherapeutic agent, wherein the chemotherapeutic agent is administered in combination with a FSTL1 suppressor.

(30) An anticancer agent comprising a chemotherapeutic agent, wherein the chemotherapeutic agent is administered in combination with an anti-FSTL1 antibody or a fragment or functional equivalent thereof.

In the present invention, one or more features mentioned above are intended to be combined as stated herein and be combinable in other ways. Those skilled in the art recognize further embodiments and advantages of the present invention by reading and understanding the detailed description given below, according to the need.

Advantageous Effects of Invention

The present invention effectively suppresses the metastasis of cancer cells directly by acting on the cancer cells through the inhibition of FSTL1 or indirectly by suppressing the differentiation induction and growth of immunosuppressive or immunodeficient cells such as regulatory T cells (Tregs) or myeloid-derived suppressor cells (MDSCs) which suppress immunity, and/or the growth and differentiation induction of mesenchymal stem cells (MSCs) which promote the enhancement of immunosuppressive activity or immunodeficient activity. Furthermore, the present invention effectively suppresses even cancer metastasis considered to be difficult to suppress, particularly, bone metastasis for which an effective treatment method has not yet been established. Moreover, the present invention suppresses differentiation induction of Tregs, tumor growth, metastasis, weight loss caused by emaciation, etc., not only in bone metastasis models but in various animal cancer models. Accordingly, the present invention provides a therapeutic drug for cancer effective over multiple aspects. Also, the present invention can mitigate the whole mechanism of immunosuppression or immunodeficiency as compared with conventional ones and therefore provides even an agent for mitigation of immunosuppression or mitigation of immunodeficiency for extensive use. The agent for mitigation of immunosuppression or mitigation of immunodeficiency of the present invention is not an agent that removes some immunosuppressive cell populations such as regulatory T cells or regulatory dendritic cells or inhibits their functions, and therefore circumvents broad conventional limitations to agents for mitigation of immunosuppression. Thus, the agent of the present invention is also effective against exhausted T cells. Hence, the agent of the present invention also has an immunodeficiency-mitigating effect and is also useful as an agent for mitigation of immune defect. In the present invention, it has been found as to these effects brought about by the inhibition of FSTL1 that more remarkable effects are exerted by combining the inhibition of FSTL1 and the mechanism underlying inhibition by the chemotherapeutic agent. More specifically, unexpectedly, the inhibition of FSTL1 and the inhibition by the chemotherapeutic agent exhibited synergistic effects and enhanced an antitumor effect to be equal to or greater than the synergistic effects so that lung cancer disappeared in three out of five animals.

Description of Embodiments

Hereinafter, the embodiments of the present invention will be described in detail. Description about the same or similar contents will be appropriately omitted in order to avoid cumbersome repetition. It should be understood that the singular form of a word conceptually includes the plural form of the word throughout the present specification unless otherwise specified. Thus, it should be understood that the article of a singular noun (e.g., "a", "an", and "the") conceptually includes even the plural noun thereof unless otherwise specified. It should be understood that terms used herein have meanings usually used in the art unless otherwise specified. Thus, all technical terms and scientific terms used herein have the same meanings as those generally understood by those skilled in the art to which the present invention belongs, unless otherwise defined. If there is any contradiction, the present specification (including definitions) takes a priority.

First, the terms and general techniques used in the present invention will be described.

In the present specification, "FSTL1" gene encodes a protein with similarity to follistatin, an activin binding protein. FSTL1 contains an FS module contained in a follistatin-like sequence and reportedly has 10 conserved cysteine residues. Although the protein is thought to be an autoantigen associated with rheumatoid arthritis, recent findings are described in Patent Literature 1 (WO2009/028411). The accession numbers of FSTL1 described in NCBI are, for example, NP_009016 (NP_009016.1); NP_032073.2 (amino acid), and NM_007085 (NM_007085.4); NM_008047.5 (mRNA). The amino acid sequence of FSTL1 is represented by, for example, SEQ ID NO: 758 or SEQ ID NO: 760. The nucleotide sequence of FSTL1 mRNA is represented by, for example, SEQ ID NO: 759 or SEQ ID NO: 761. FSTL1 is not limited by its amino acid sequence as long as the protein has FSTL1 activity. Thus, it is understood that not only a protein having the amino acid sequence described in particular SEQ ID NO or accession number (or a nucleic acid encoding the protein) but a functionally active derivative, analog, or mutant thereof, or a functionally active fragment thereof, or a homolog thereof, or a mutant encoded by a nucleic acid hybridizing under highly stringent conditions or low stringent conditions to a nucleic acid encoding this protein can be used in the present invention as long as the specific object of the present invention is met.

"Derivative", "analog", or "mutant" (or "variant") used herein preferably includes a molecule containing a region substantially homologous to the protein of interest (e.g., FSTL1), though any limitation is not intended. In various embodiments, such a molecule is identical by at least 30%, 40%, 50%, 60%, 70%, 80%, 90%, 95%, or 99% over amino acid sequences of the same sizes or when compared with a sequence aligned by alignment using a computer homology program known in the art, or a nucleic acid encoding such a molecule is capable of hybridizing to a sequence encoding the constituent protein, under (highly) stringent conditions, moderately stringent conditions, or non-stringent conditions. This is a product altered from a naturally occurring protein by amino acid substitution, deletion, and/or addition, and means that the protein derivative still exhibits the biological functions of the naturally occurring protein to the same extent or not to the same extent. The biological functions of such a protein may be examined by, for example, appropriate and available in vitro assay described herein or known in the art. The phrase "functionally active" used herein means that a polypeptide, i.e., a fragment or a derivative, has the structural functions, controlling functions, or biochemical functions of the protein, such as biological activity, according to an aspect related to the polypeptide, i.e., fragment or derivative, of the present invention in the present specification. In the present invention, humans are mainly discussed about FSTL1. However, many non-human animals are known to express FSTL1. Therefore, it is understood that these animals, particularly, mammals, are also included in the scope of the present invention.

Thus, the typical nucleotide sequence of FSTL1 can be (a) a polynucleotide having the nucleotide sequence represented by SEQ ID NO: 758 or SEQ ID NO: 760 or a fragment sequence thereof;

(b) a polynucleotide encoding a polypeptide consisting of the amino acid sequence represented by SEQ ID NO: 759 or SEQ ID NO: 761 or a fragment thereof;

(c) a polynucleotide encoding an altered polypeptide having one mutation selected from the group consisting of substitution, addition, and deletion of one or more amino acids in the amino acid sequence represented by SEQ ID NO: 759 or SEQ ID NO: 761, or a fragment thereof, the altered polypeptide having biological activity;

(d) a polynucleotide which is a splicing variant or allelic variant of the nucleotide sequence represented by SEQ ID NO: 758 or SEQ ID NO: 760, or a fragment thereof;

(e) a polynucleotide encoding a homolog of a polypeptide consisting of the amino acid sequence represented by SEQ ID NO: 759 or SEQ ID NO: 761, or a fragment thereof;

(f) a polynucleotide that hybridizes under stringent conditions to any one of the polynucleotides (a) to (e) and encodes a polypeptide having biological activity; or (g) a polynucleotide that consists of a nucleotide sequence having at least 70%, at least 80%, at least 90%, at least 95%, at least 96%, at least 97%, at least 98%, or at least 99% identity to any one of the polynucleotides (a) to (e) or a complementary sequence thereof, and encodes a polypeptide having biological activity.

In this context, the biological activity typically refers to activity possessed by FSTL1 or means that a marker can be differentiated from other proteins present in the same organism.

The amino acid sequence of FSTL1 can be (a) a polypeptide consisting of the amino acid sequence represented by SEQ ID NO: 759 or SEQ ID NO: 761 or a fragment thereof;

(b) a polypeptide that has one mutation selected from the group consisting of substitution, addition, and deletion of one or more amino acids in the amino acid sequence represented by SEQ ID NO: 759 or SEQ ID NO: 761, and has biological activity;

(c) a polypeptide encoded by a splicing variant or allelic variant of the nucleotide sequence represented by SEQ ID NO: 758 or SEQ ID NO: 760;

(d) a polypeptide which is a homolog of the amino acid sequence represented by SEQ ID NO: 759 or SEQ ID NO: 761; or (e) a polypeptide that has an amino acid sequence having at least 70%, at least 80%, at least 90%, at least 95%, at least 96%, at least 97%, at least 98%, or at least 99% identity to any one of the polypeptides (a) to (d), and has biological activity.

In this context, the biological activity typically refers to activity possessed by FSTL1 or means that a marker can be differentiated from other proteins present in the same organism (e.g., an antigen used contains a region capable of functioning as a specific epitope). SEQ ID NOs: 758 to 761 each encode or represent a precursor containing a leader sequence. The first 20 amino acids (methionine to alanine) in SEQ ID NO: 759 and the first 18 amino acids (methionine to glycine) in SEQ ID NO: 761 are leader sequences. Thus, in the present invention, the amino acid sequence of the term FSTL1 may refer to a sequence after deletion of the leader sequence.

In relation to the present invention, "substance binding to FSTL1", "FSTL1 binding agent", or "FSTL1 interacting molecule" is a molecule or a substance binding to FSTL1 at least transiently. Preferably, it is advantageous for detection to be able to display binding (e.g., to be labeled or be a labelable state), and it is advantageous for treatment to be further bound with an agent for treatment. Examples of the substance binding to FSTL1 can include antibodies, antisense oligonucleotides, siRNA, low-molecular-weight molecules (LMW), binding peptides, aptamers, ribozymes, and peptidomimetics. The substance binding to FSTL1 or the "FSTL1 interacting molecule may be an inhibitor of FSTL1 and also includes, for example, a binding protein or a binding peptide directed to FSTL1, particularly, directed to an active site of FSTL1, and a nucleic acid directed to the FSTL1 gene. The nucleic acid against FSTL1 refers to, for example, double-stranded or single-stranded DNA or RNA inhibiting the expression of the FSTL1 gene or the activity of FSTL1, or a modified form or derivative thereof, and further includes, but is not limited to, an antisense nucleic acid, an aptamer, siRNA (small interfering RNA), and a ribozyme. In the present specification, "binding protein" or "binding peptide" as to FSTL1 refers to an arbitrary protein or peptide binding to FSTL1 and further includes, but is not limited to, an antibody (e.g., a polyclonal antibody or a monoclonal antibody), an antibody fragment, and a functional equivalent directed to FSTL1.

In the present specification, "chemotherapy" when used as to cancer refers to therapy using an agent having suppressive action on cancer or cancer cells. A chemical substance for use for this purpose is referred to as a "chemotherapeutic agent". Thus, in the present specification, "chemotherapeutic agent" is defined as an agent which is a chemically synthesized substance having suppressive action on malignant tumor, and is preferably an agent that is delivered into cells and has a function of inhibiting the growth of cancer cells. Examples of the chemotherapeutic agent can include, but are not limited to, alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In a preferred embodiment, the chemotherapeutic agent used in the present invention has a function of inhibiting DNA synthesis. This is because it was able to be found in the present invention that use of cyclophosphamide, which has a function of inhibiting DNA synthesis, with the anti-FSTL1 antibody serving as a FSTL1 suppressor produces remarkable synergistic effects. More specifically, in the present invention, the chemotherapeutic agent comprises an alkylating agent or an antimetabolite and is more preferably an alkylating agent. Examples of the alkylating agent can include cyclophosphamide and derivatives thereof. Examples of the antimetabolite can include, but are not limited to, 5-fluorouracil (5-FU) and derivatives thereof.

Although not wishing to be bound by any theory, it is considered that effects found in combined use of "alkylating agent" and a FSTL1 suppressor shown herein in Examples can be achieved in a chemotherapeutic agent other than "alkylating agent" as the chemotherapeutic agent. Although not wishing to be bound by any theory, this is because the chemotherapeutic agent acts not only on cancer cells but on normal cells, regardless of its type and regardless of the degree of influence, and might therefore suppress the growth of normal cells, though the chemotherapeutic agent can suppress the growth of cancer cells. Thus, the growth of immune-related cells necessary for eliminating cancer is also suppressed, and the elimination of cancer by improvement in immunity cannot be expected. On the other hand, as shown in the present specification, the FSTL1 suppressor such as the anti-FSTL1 antibody is an agent leading to improvement in immune functions against cancer. When the chemotherapeutic agent such as "alkylating agent" is used in combination with the anti-FSTL antibody serving as a FSTL1 suppressor as shown in the present specification, an unexpected additional effect such as the stable conferring of an anticancer effect by decrease in variations in tumor suppressive effect, etc. is conferred. Also, as indicated by an unexpected decrease in mortality (unexpected increase in remission), etc., synergistic effects brought about by combination therapy with the chemotherapeutic agent were demonstrated. The chemotherapeutic agent other than "alkylating agent" is expected to produce similar synergistic effects by an effect of improving immune functions against cancer by the FSTL1 suppressor.

In the present specification, "protein", "polypeptide", "oligopeptide", and "peptide" are used herein interchangeably with each other and refer to an amino acid polymer having an arbitrary length. This polymer may be linear or branched or may be cyclic. The amino acid may be natural or non-natural or may be an altered amino acid. This term may also encompass an assembly of a plurality of polypeptide chains as a complex. This term also encompasses a naturally or artificially altered amino acid polymer. Such alteration encompasses, for example, disulfide bond formation, glycosylation, lipidation, acetylation, phosphorylation, or any other operation or alteration (e.g., conjugation with a labeling component). This definition also encompasses, for example, a polypeptide containing analogs of one or two or more amino acids (including e.g., a non-natural amino acid), a peptide-like compound (e.g., a peptoid), and other alterations known in the art. In the present specification, "amino acid" is a generic name for organic compounds having amino and carboxyl groups. When the antibody according to the embodiments of the present invention comprises "particular amino acid sequence", any amino acid in the amino acid sequence may receive chemical modification. Also, any amino acid in the amino acid sequence may form a salt or a solvate. Also, any amino acid in the amino acid sequence may be in a L- or D-form. In such cases, the protein according to the embodiments of the present invention is also interpreted to comprise the "particular amino acid sequence" described above. For example, N-terminal modification (e.g., acetylation and myristoylation), C-terminal modification (e.g., amidation and glycosylphosphatidylinositol addition), or side chain modification (e.g., phosphorylation and glycosylation) is known as the in vivo chemical modification of amino acids contained in proteins. The modification may be natural or non-natural as long as the object of the present invention is met.

In the present specification, "polynucleotide", "oligonucleotide", and "nucleic acid" are used herein interchangeably with each other and refer to a nucleotide polymer having an arbitrary length. This term also includes "oligonucleotide derivative" or "polynucleotide derivative". "Oligonucleotide derivative" or "polynucleotide derivative" refers to an oligonucleotide or a polynucleotide that contains a nucleotide derivative or has an internucleotide bond different from a usual one, and is used interchangeably. Specific examples of such an oligonucleotide include 2'-O-methyl-ribonucleotide, an oligonucleotide derivative in which a phosphodiester bond in an oligonucleotide has been converted to a phosphorothioate bond, an oligonucleotide derivative in which a phosphodiester bond in an oligonucleotide has been converted to a N3'-P5' phosphoramidate bond, an oligonucleotide derivative in which ribose and a phosphodiester bond in an oligonucleotide have been converted to a peptide nucleic acid bond, an oligonucleotide derivative in which uracil in an oligonucleotide has been replaced with C-5 propynyluracil, an oligonucleotide derivative in which uracil in an oligonucleotide has been replaced with C-5 thiazoleuracil, an oligonucleotide derivative in which cytosine in an oligonucleotide has been replaced with C-5 propynylcytosine, an oligonucleotide derivative in which cytosine in an oligonucleotide has been replaced with phenoxazine-modified cytosine, an oligonucleotide derivative in which ribose in DNA has been replaced with 2'-O-propylribose, and an oligonucleotide derivative in which ribose in an oligonucleotide has been replaced with 2'-methoxyethoxyribose. A particular nucleic acid sequence is also intended to encompass an explicitly shown sequence as well as a conservatively altered form (e.g., a degenerate codon substitution variant) and a complementary sequence thereof, unless otherwise specified. Specifically, the degenerate codon substitution variant can be achieved by preparing a sequence in which the third position of one or more selected (or all) codons has been replaced with a mixed base and/or a deoxyinosine residue (Batzer et al., Nucleic Acid Res. 19: 5081 (1991); Ohtsuka et al., J. Biol. Chem. 260: 2605-2608 (1985); and Rossolini et al., Mol. Cell. Probes 8: 91-98 (1994)). In the present specification, "nucleic acid" is also used interchangeably with a gene, cDNA, mRNA, an oligonucleotide, and a polynucleotide. In the present specification, "nucleotide" may be natural or non-natural.

In the present specification, "gene" refers to an agent that governs genetic traits. "Gene" may refer to "polynucleotide", "oligonucleotide", and "nucleic acid".

In the present specification, "homology" of genes refers to the degree of identity between two or more gene sequences. In general, having "homology" means that the degree of identity or similarity is high. Thus, as the homology of two certain genes is higher, the identity or similarity of their sequences is higher. Whether or not two types of genes have homology can be examined by the direct comparison of their sequences or hybridization under stringent conditions for nucleic acids. In the case of directly comparing two gene sequences, these genes have homology when their DNA sequences are identical by typically at least 50%, preferably at least 70%, more preferably at least 80%, 90%, 95%, 96%, 97%, 98%, or 99% between the gene sequences. Thus, in the present specification, "homolog" or "homologous gene product" means a protein of another species, preferably a mammalian protein, which exerts the same biological functions as those of a protein constituent of a complex further described herein. Such a homolog is also referred to as "ortholog gene product". It is understood that such a homolog, a homologous gene product, an ortholog gene product, or the like can also be used as long as the object of the present invention is met.

An amino acid can be mentioned herein by a generally known three-letter code thereof or a one-letter code recommended by IUPAC-IUB Biochemical Nomenclature Commission. Likewise, a nucleotide may be mentioned by a generally recognized one-letter code. In the present specification, the comparison of similarity, identity, and homology between amino acid sequences and nucleotide sequences is calculated using a tool BLAST for sequence analysis with default parameters. Identity search can be performed using, for example, NCBI BLAST 2.2.28 (issued on Apr. 2, 2013). In the present specification, the value of identity usually refers to a value obtained by alignment under default conditions using the BLAST described above. However, in the case where a higher value is obtained by change of a parameter, the highest value is used as the value of identity. In the case where identity is evaluated for a plurality of regions, the highest value thereamong is used as the value of identity. The similarity is a numerical value calculated by including similar amino acids in addition to the identity.

In one embodiment of the present invention, the term "several" may be, for example, 10, 8, 6, 5, 4, 3, or 2 or may be equal to or less than any of these values. A polypeptide that has undergone the deletion, addition, or insertion of 1 or several amino acid residues, or the substitution of 1 or several amino acid residues by other amino acids is known to maintain its biological activity (Mark et al., Proc Natl Acad Sci USA. 1984 September; 81 (18): 5662-5666; Zoller et al., Nucleic Acids Res. 1982 Oct. 25; 10 (20): 6487-6500; and Wang et al., Science. 1984 Jun. 29; 224 (4656): 1431-1433.). An antibody that has undergone deletion, etc. can be prepared by, for example, site-directed mutagenesis, random mutagenesis, or biopanning using antibody phage libraries. For example, KOD-Plus-Mutagenesis Kit (Toyobo Co., Ltd.) can be used in the site-directed mutagenesis. The selection of an antibody having activity similar to that of wild type from mutant-type antibodies in which deletion, etc. has been introduced can be achieved by various characterization techniques such as FACS analysis or ELISA.

In one embodiment of the present invention, the phrase "90% or higher" may be, for example, 90, 95, 96, 97, 98, 99, or 100% or higher and may be within the range of any two of these values. The "homology" described above may be calculated as the percentage of the number of homologous amino acids between two or more amino acid sequences according to a method known in the art. Before the calculation of the percentage, a gap is introduced to a portion of amino acid sequences, if required, in order to align the amino acid sequences of an amino acid sequence group for comparison and maximize the percentage of identical amino acids. A method for alignment, a method for calculating the percentage, a comparison method, and a computer program associated therewith have heretofore been well known in the art (e.g., BLAST and GENETYX). In the present specification, "homology" can be represented by a value measured by NCBI BLAST, unless otherwise specified. Default setting of Blastp can be used in algorithms for comparing amino acid sequences by BLAST. The measurement results are converted to numerical values as positives or identities.

In the present specification, "polynucleotide hybridizing under stringent conditions" refers to well-known conditions conventionally used in the art. Such a polynucleotide can be obtained by use of colony hybridization, plaque hybridization, Southern blot hybridization, or the like using a polynucleotide selected from among the polynucleotides of the present invention as a probe. Specifically, the polynucleotide means a polynucleotide that can be identified by hybridization at 65° C. in the presence of 0.7 to 1.0 M NaCl using a colony- or plaque-derived DNA-immobilized filter, followed by the washing of the filter under 65° C. conditions using a 0.1 to 2×SSC (saline-sodium citrate) solution (the composition of a 1×SSC solution is 150 mM sodium chloride and 15 mM sodium citrate). "Stringent conditions" can adopt, for example, the following conditions: (1) low ion strength and high temperature are used for washing (e.g., 0.015 M sodium chloride/0.0015 M sodium citrate/0.1% sodium dodecyl sulfate at 50° C.), (2) a denaturant such as formamide is used in hybridization (e.g., 50% (v/v) formamide, 0.1% bovine serum albumin/0.1% Ficoll/0.1% polyvinylpyrrolidone/50 mM sodium phosphate buffer (pH 6.5), 750 mM sodium chloride, and 75 mM sodium citrate at 42° C.), or (3) the filter is incubated overnight at 37° C. in a solution containing 20% formamide, 5×SSC, 50 mM sodium phosphate (pH 7.6), a 5×Denhardt's solution, 10% dextran sulfate, and 20 mg/ml of denatured sheared salmon sperm DNA, and then washed with 1×SSC at approximately 37 to 50° C. The formamide concentration may be 50% or higher. The washing time may be 5, 15, 30, 60, or 120 minutes or longer. A plurality of factors such as temperature and salt concentration are possible as factors that influence the stringency of hybridization reaction. For the details, see Ausubel et al., Current Protocols in Molecular Biology, Wiley Interscience Publishers, (1995). An example of "highly stringent conditions" is 0.0015 M sodium chloride and 0.0015 M sodium citrate at 65 to 68° C., or 0.015 M sodium chloride, 0.0015 M sodium citrate, and 50% formamide at 42° C. The hybridization can be performed according to a method described in an experimental manual such as Molecular Cloning 2nd ed., Current Protocols in Molecular Biology, Supplement 1-38, or DNA Cloning 1: Core Techniques, A Practical Approach, Second Edition, Oxford University Press (1995). In this context, preferably, a sequence comprising only an A sequence or only a T sequence is excluded from a sequence hybridizing under stringent conditions. Moderately stringent conditions can be readily determined by those skilled in the art on the basis of, for example, the length of DNA, and are shown in Sambrook et al., Molecular Cloning: A Laboratory Manual, 3rd ed., Vol. 1, 7.42-7.45 Cold Spring Harbor Laboratory Press, 2001. As for a nitrocellulose filter, the moderately stringent conditions include use of hybridization conditions involving a prewashing solution of 5×SSC, 0.5% SDS, and 1.0 mM EDTA (pH 8.0), and approximately 50% formamide and 2×SSC to 6×SSC at approximately 40 to 50° C. (or any other similar hybridization solution such as a Stark's solution in approximately 50% formamide at approximately 42° C.), and washing conditions involving approximately 60° C., 0.5×SSC, and 0.1% SDS. Thus, the polypeptide used in the present invention also encompasses a polypeptide encoded by a nucleic acid molecule hybridizing under highly or moderately stringent conditions to a nucleic acid molecule encoding the polypeptide particularly described in the present invention.

In the present specification, "purified" substance or biological agent (e.g., nucleic acid or protein) refers to the substance or biological agent from which at least a portion of natural accompaniments has been removed. Thus, for the purified biological agent, the purity of the biological agent is usually higher than that in a state where the biological agent is normally present (i.e., the biological agent is concentrated). The term "purified" used herein means that preferably at least 75% by weight, more preferably at least 85% by weight, still more preferably at least 95% by weight, most preferably at least 98% by weight of a homotypic biological agent is present. The substance or biological agent used in the present invention is preferably a "purified" substance. "Isolated" substance or biological agent (e.g., nucleic acid or protein) used herein refers to the substance or biological agent from which natural accompaniments have been substantially removed. The term "isolated" used herein varies depending on the purpose and therefore, is not necessarily required to be indicated by purity. If necessary, this term means that preferably at least 75% by weight, more preferably at least 85% by weight, still more preferably at least 95% by weight, most preferably at least 98% by weight of a homotypic biological agent is present. The substance used in the present invention is preferably an "isolated" substance or biological agent.

In the present specification, "corresponding" amino acid or nucleic acid, or moiety refers to an amino acid or a nucleotide having or presumed to have action similar to that of a predetermined amino acid or nucleotide, or moiety in a reference polypeptide or polynucleotide for comparison, in a certain polypeptide molecule or polynucleotide molecule (e.g., FSTL1). Particularly, this term refers to an amino acid that is located at a similar position in an active site and similarly contributes to catalytic activity, for an enzyme molecule, and refers to a corresponding moiety (e.g., a transmembrane domain) for a complex molecule. For example, for an antisense molecule, the corresponding amino acid or nucleic acid, or moiety can be a similar moiety in an ortholog corresponding to a particular moiety of the antisense molecule. The corresponding amino acid can be, for example, a particular amino acid that undergoes cysteinylation, glutathionylation, S—S bond formation, oxidation (e.g., oxidation of a methionine side chain), formylation, acetylation, phosphorylation, glycosylation, myrstylation, or the like. Alternatively, the corresponding amino acid may be an amino acid in charge of dimerization. Such "corresponding" amino acid or nucleic acid may be a region or a domain that spans a given range. Thus, in such a case, the corresponding amino acid or nucleic acid is referred herein to as "corresponding" region or domain. In the present invention, such a corresponding region or domain is useful for designing a complex molecule.

In the present specification, "corresponding" gene (e.g., polynucleotide sequence or molecule) refers to a gene (e.g., polynucleotide sequence or molecule) having or presumed to have action similar to a predetermined gene in a reference species for comparison, in a certain species. In the case where a plurality of genes having such action are present, the corresponding gene refers to a gene having evolutionarily the same origin. Thus, a gene corresponding to a certain gene can be an ortholog of the gene. Thus, human FSTL1 can be found as corresponding FSTL1 in other animals (particularly, mammals). Such a corresponding gene can be identified by use of a technique well known in the art. Thus, for example, a corresponding gene in a certain animal (e.g., mouse) can be found by using sequences such as SEQ ID NOs: 758 to 761 as query sequences for a reference gene (e.g., FSTL1) of the corresponding gene and searching a database involving the sequences of the animal.

In the present specification, "fragment" refers to a polypeptide or a polynucleotide having a sequence length of 1 to n−1 with respect to a full-length polypeptide or polynucleotide (length: n). The length of the fragment can be appropriately changed according to the purpose. Examples of the lower limit of the length of the polypeptide include 3, 4, 5, 6, 7, 8, 9, 10, 15, 20, 25, 30, 40, and 50 or more amino acids. A length represented by an integer that is not specifically listed here (e.g., 11) may also be appropriate for the lower limit. Examples of the lower limit of the length of the polynucleotide include 5, 6, 7, 8, 9, 10, 15, 20, 25, 30, 40, 50, 75, and 100 or more nucleotides. A length represented by an integer that is not specifically listed here (e.g., 11) may also be appropriate for the lower limit. In the present specification, it is understood that in the case where a full-length molecule functions as, for example, a marker or a target molecule, such a fragment is included in the scope of the present invention as long as the fragment itself also has the functions as a marker or a target molecule.

According to the present invention, the term "activity" refers to a function of a molecule in the broadest sense in the present specification. The activity generally includes a biological function, a biochemical function, a physical function, or a chemical function of the molecule, though any limitation is not intended. The activity includes, for example, enzymatic activity, the ability to interact with other molecules, the ability to activate, promote, stabilize, inhibit, suppress, or destabilize the functions of other molecules, stability, or the ability to localize to a particular intracellular position. This term also relates to a function of a protein complex in the broadest sense, if applicable.

In the present specification, "biological function" when a certain gene or a nucleic acid molecule or polypeptide related thereto is mentioned refers to a particular function that can be possessed in vivo by the gene, the nucleic acid molecule, or the polypeptide. Examples thereof can include, but are not limited to, production of a specific antibody, enzymatic activity, and conferring of resistance. In the present invention, examples thereof can include, but are not limited to, a function by which FSTL1 is involved in the inhibition of VLDL uptake, etc. In the present specification, the biological function can be exerted by "biological activity". In the present specification, "biological activity" refers to activity that can be possessed in vivo by a certain agent (e.g., polynucleotide and protein). The biological activity encompasses activity that exerts various functions (e.g., transactivating activity) and also encompasses, for example, activity of interacting with a certain molecule to activate or deactivate another molecule. In the case where two agents interact with each other, the biological activity can be the binding between these two molecules and biological change caused thereby. For example, two molecules are considered to be bound with each other when an antibody is precipitated using one of the molecules and also coprecipitated with the other molecule. Thus, the examination of such coprecipitation is one judgment approach. In the case where the certain agent is, for example, an enzyme, the biological activity encompasses its enzymatic activity. In another example, in the case where the certain agent is a ligand, the biological activity encompasses the binding of the ligand to a corresponding receptor. Such biological activity can be measured by a technique well known in the art. Thus, "activity" refers to various measurable indexes that indicate or reveal binding (either directly or indirectly) or influence response (i.e., having measurable influence that responds to any exposure or stimulation). Examples thereof include the affinity of a compound binding directly to the polypeptide or the polynucleotide of the present invention, the amount of an upstream or downstream protein after some stimuli or events, and measures of other similar functions.

In the present specification, "expression" of a gene, a polynucleotide, a polypeptide, or the like means that the gene, etc. assumes a different form by given action in vivo. Preferably, this term means that the gene, the polynucleotide, etc. assumes a polypeptide form through transcription and translation. The preparation of mRNA by transcription is also one form of expression. Thus, in the present specification, "expression product" includes such a polypeptide or a protein, or mRNA. More preferably, such a polypeptide form can be a post-translationally processed form. For example, the expression level of FSTL1 can be determined by an arbitrary method. Specifically, the expression level of FSTL1 can be determined by evaluating the amount of FSTL1 mRNA, the amount of the FSTL1 protein, and the biological activity of the FSTL1 protein. Such a measurement value can be used in companion diagnostics. The amount of the FSTL1 mRNA or protein can be determined by a method described in detail in another section herein or any other method known in the art.

In the present specification, "functional equivalent" refers to an arbitrary form that has an intended function equivalent to that of the original entity of interest, but differs structurally therefrom. Thus, it is understood that a functional equivalent of "FSTL1", or an antibody thereagainst is not FSTL1, or the antibody itself, but encompasses a mutant or altered form (e.g., an amino acid sequence altered form) of FSTL1, or the antibody having biological effects possessed by FSTL1, and a form that can be converted to FSTL1, or the antibody itself, or a mutant or altered form of this FSTL1, or the antibody at the time of acting (including e.g., a nucleic acid encoding FSTL1, or the antibody itself, or a mutant or altered form of this FSTL1, or the antibody, and a vector, a cell, and the like comprising the nucleic acid). In the present invention, it is understood that the functional equivalent of FSTL1, or an antibody thereagainst can be used similarly to FSTL1, or the antibody even if no mentioned so. The functional equivalent can be found by searching a database or the like. In the present specification, "search" refers to utilization of a certain nucleic acid nucleotide sequence electronically or in a biological or any other method to find another nucleic acid nucleotide sequence having a particular function and/or property. Examples of the electronical search include, but are not limited to, BLAST (Altschul et al., J. Mol. Biol. 215: 403-410 (1990)), FASTA (Pearson & Lipman, Proc. Natl. Acad. Sci., USA 85: 2444-2448 (1988)), Smith and Waterman method (Smith and Waterman, J. Mol. Biol. 147: 195-197 (1981)), and Needleman and Wunsch method (Needleman and Wunsch, J. Mol. Biol. 48: 443-453 (1970)). Examples of the biological search include, but are not limited to, stringent hybridization, macroarrays containing genomic DNA attached to nylon membranes or the like or microarrays containing genomic DNA attached to glass sheets (microarray assay), PCR, and in situ hybridization. In the present specification, the gene used in the present invention is intended to also include a corresponding gene identified by such electronical search or biological search.

An amino acid sequence having the insertion, substitution, or deletion of one or more amino acids, or the addition thereof to one or both of the ends can be used in the functional equivalent of the present invention. In the present specification, "amino acid sequence having the insertion, substitution, or deletion of one or more amino acids, or the addition thereof to one or both of the ends" means that the amino acid sequence has been altered by the substitution, etc. of a plurality of amino acids to an extent that can occur naturally by a well-known technical method such as site-directed mutagenesis, or by natural mutation. The altered amino acid sequence can be a sequence that has undergone the insertion, substitution, or deletion of, for example, 1 to 30, preferably 1 to 20, more preferably 1 to 9, further preferably 1 to 5, particularly preferably 1 or 2 amino acids, or the addition thereof to one or both of the ends. The altered amino acid sequence may be preferably an amino acid sequence derived from the amino acid sequence of a polypeptide such as FSTL1 or an antibody by the conservative substitution of one or more (preferably 1 or several or 1, 2, 3, or 4) amino acids. In this context, "conservative substitution" means that one or more amino acid residues are substituted by other amino acid residues chemically similar thereto so as not to substantially alter the functions of the protein. Examples thereof include the substitution of a certain hydrophobic residue by another hydrophobic residue, and the substitution of a certain polar residue by another polar residue having the same electric charge thereas. Functionally similar amino acids that permit such substitution are known in the art about each amino acid. Specific examples thereof include: non-polar (hydrophobic) amino acids such as alanine, valine, isoleucine, leucine, proline, tryptophan, phenylalanine, and methionine; polar (neutral) amino acids such as glycine, serine, threonine, tyrosine, glutamine, asparagine, and cysteine; positively charged (basic) amino acids such as arginine, histidine, and lysine; and negatively charged (acidic) amino acids such as aspartic acid and glutamic acid.

In the present specification, "suppressor" refers to a substance or an agent that inhibits the biological effects of the entity of interest (e.g., receptor or cells). The FSTL1 suppressor of the present invention is an agent that can transiently or permanently reduce or delete the functions of the FSTL1 or FSTL1-expressing cells, etc. of interest. Examples of such an agent can include, but are not limited to, forms of antibodies, antigen binding fragments thereof, derivatives of the antibodies or the fragments, functional equivalents, antisenses, and nucleic acids such as RNAi agents (e.g., siRNA).

In the present specification, "agonist" refers to a substance that exhibits or enhances the biological effects of the entity of interest (e.g., receptor). Examples thereof can include natural agonists (also called ligands) as well as synthesized or altered agonists.

In the present specification, "antagonist" refers to a substance that suppresses or inhibits the exertion of the biological effects of the entity of interest (e.g., receptor).

Examples thereof can include natural antagonists as well as synthesized or altered antagonists. The antagonist includes, for example, a substance that performs competitive suppression or inhibition with an agonist (or ligand) as well as a substance that performs non-competitive suppression or inhibition therewith. The antagonist can be obtained by altering the agonist. Because of suppressing or inhibiting physiological phenomena, the antagonist may be conceptually encompassed by a suppressor (inhibitor) or a suppressive (suppressing) agent. Thus, the antagonist is used herein substantially interchangeably with "suppressor".

In the present specification, "antibody" includes a polyclonal antibody, a monoclonal antibody, a multispecific antibody, a chimeric antibody, and an anti-idiotype antibody, and their fragments, for example, a Fv fragment, a Fab' fragment, F(ab')2, and a Fab fragment, and any other conjugate or functional equivalent produced by recombination (e.g., a chimeric antibody, a humanized antibody, a multifunctional antibody, a bispecific or oligospecific antibody, a single-chain antibody, scFv, diabody, sc(Fv)2 (single chain (Fv)2), and scFv-Fc), in a broad sense. Such an antibody may be further covalently bound with or recombinantly fused with an enzyme, for example, alkaline phosphatase, horseradish peroxidase, or a galactosidase. The anti-FSTL1 antibody used in the present invention is not limited by its origin, type, shape, etc. as long as the antibody binds to the FSTL1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "anti-FSTL1 antibody" includes an antibody having binding activity against FSTL1. A method for producing this anti-FSTL1 antibody is not particularly limited, and the antibody may be produced, for example, by immunizing a mammal or bird with FSTL1.

It is also understood that "functional equivalent" of "antibody against FSTL1 (anti-FSTL1 antibody) or fragment thereof" also encompasses, for example, in the case of an antibody, the antibody itself and its fragment itself having binding activity and, if necessary, suppressive activity against FSTL1 as well as a chimeric antibody, a humanized antibody, a multifunctional antibody, a bispecific or oligospecific antibody, a single-chain antibody, scFv, diabody, sc(Fv)2 (single chain (Fv)2), scFv-Fc, and the like.

The anti-FSTL1 antibody according to one embodiment of the present invention is preferably an anti-FSTL1 antibody specifically binding to a particular epitope on FSTL1, from the viewpoint that the growth of malignant tumor is particularly strongly suppressed.

The anti-FSTL1 antibody according to one embodiment of the present invention may be a monoclonal antibody. The monoclonal antibody can be allowed to act on FSTL1 more efficiently than a polyclonal antibody. It is preferred to immunize a chicken with FSTL1, from the viewpoint of efficiently producing the anti-FSTL1 monoclonal antibody.

The antibody class of the anti-FSTL1 antibody according to one embodiment of the present invention is not particularly limited and may be, for example, IgM, IgD, IgG, IgA, IgE, or IgY.

The anti-FSTL1 antibody according to one embodiment of the present invention may be an antibody fragment having antigen binding activity (hereinafter, also referred to as "antigen binding fragment"). This case is effective, for example, for elevating stability or antibody production efficiency.

The anti-FSTL1 antibody according to one embodiment of the present invention may be a fusion protein. This fusion protein may be the anti-FSTL1 antibody N- or C-terminally bound with a polypeptide or an oligopeptide. In this context, the oligopeptide may be a His tag. The fusion protein may also be the anti-FSTL1 antibody fused with a partial sequence of a mouse, human, or chicken antibody. Such fusion proteins are also included in one form of the anti-FSTL1 antibody according to the present embodiment.

The anti-FSTL1 antibody according to one embodiment of the present invention may be an antibody obtained through, for example, the step of immunizing an organism with purified FSTL1, FSTL1-expressing cells, or a FSTL1-containing lipid membrane. It is preferred to use FSTL1-expressing cells in the immunization, from the viewpoint of enhancing therapeutic effects on FSTL1-positive malignant tumor.

The anti-FSTL1 antibody according to one embodiment of the present invention may be an antibody having the CDR set of the antibody obtained through the step of immunizing an organism with purified FSTL1, FSTL1-expressing cells, or a FSTL1-containing lipid membrane. It is preferred to use FSTL1-expressing cells in the immunization, from the viewpoint of enhancing therapeutic effects on FSTL1-positive malignant tumor. The CDR set is a set of heavy chain CDR1, CDR2, and CDR3 and light chain CDR1, CDR2, and CDR3.

In one embodiment of the present invention, "FSTL1-expressing cells" may be obtained, for example, by transfecting cells with a polynucleotide encoding FSTL1, followed by the expression of FSTL1. In this context, the FSTL1 includes a FSTL1 fragment. In one embodiment of the present invention, "FSTL1-containing lipid membrane" may be obtained, for example, by mixing FSTL1 with a lipid bilayer. In this context, the FSTL1 includes a FSTL1 fragment. The anti-FSTL1 antibody according to one embodiment of the present invention is preferably an antibody obtained through the step of immunizing a chicken with the antigen, or an antibody having the CDR set of the antibody, from the viewpoint of enhancing therapeutic effects on FSTL1-positive malignant tumor.

The anti-FSTL1 antibody according to one embodiment of the present invention may have any avidity as long as the purpose is attained. Examples thereof can include, but are not limited to, a KD value (kd/ka) of at least $1.0 \times 10^6$ (M) or less, $2.0 \times 10^6$ (M) or less, $5.0 \times 10^6$ (M) or less, and $1.0 \times 10^7$ or less. Usually, the KD value (kd/ka) may be $1.0 \times 10^{-7}$ (M) or less and can be $1.0 \times 10^{-9}$ (M) or $1.0 \times 10^{-10}$ (M) or less.

The anti-FSTL1 antibody according to one embodiment of the present invention may have ADCC or CDC activity.

The anti-FSTL1 antibody according to one embodiment of the present invention may be an antibody binding to wild-type or mutant-type FSTL1. The mutant type includes a form attributed to the difference in DNA sequence among individuals. The amino acid sequence of the wild-type or mutant-type FSTL1 has preferably 80% or higher, more preferably 90% or higher, more preferably 95% or higher, particularly preferably 98% or higher homology to the amino acid sequence represented by SEQ ID NO: 759 or SEQ ID NO: 761.

In one embodiment of the present invention, "antibody" includes a molecule that can specifically bind to a particular epitope on an antigen, or a population thereof. Also, the antibody may be a polyclonal antibody or a monoclonal antibody. The antibody can be present in various forms and may be in one or more forms selected from the group consisting of, for example, a full-length antibody (antibody having Fab and Fc regions), a Fv antibody, a Fab antibody, a F(ab')2 antibody, a Fab' antibody, diabody, a single-chain antibody (e.g., scFv), dsFv, a multispecific antibody (e.g., a bispecific antibody), a peptide or polypeptide having antigen binding activity, a chimeric antibody (e.g., a mouse-human chimeric antibody and a chicken-human chimeric antibody), a mouse antibody, a chicken antibody, a humanized antibody, a human antibody, and their equivalents. The antibody also includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach. Such an antibody may be further covalently bound with or recombinantly fused with an enzyme, for example, alkaline phosphatase, horseradish peroxidase, or a galactosidase. The anti-FSTL1 antibody used in the present invention is not limited by its origin, type, shape, etc. as long as the antibody binds to the FSTL1 protein. Specifically, a publicly known antibody such as a non-human animal antibody (e.g., a mouse antibody, a rat antibody, and a camel antibody), a human antibody, a chimeric antibody, or a humanized antibody can be used. In the present invention, a monoclonal or polyclonal antibody can be used, and a monoclonal antibody is preferred. The binding of the antibody to the FSTL1 protein is preferably specific binding. Also, the antibody includes a modified form of the antibody or a non-modified form of the antibody. The modified form of the antibody may be the antibody bound with any of various molecules, for example, polyethylene glycol. The modified form of the antibody can be obtained by chemically modifying the antibody using a publicly known approach.

In one embodiment of the present invention, "polyclonal antibody" can be produced, for example, by administering an immunogen comprising the intended antigen to a mammal (e.g., a rat, a mouse, a rabbit, cattle, and a monkey), bird, or the like in order to induce the production of an antigen-specific polyclonal antibody. The administration of the immunogen may be the injection of one or more immunizing agents and, if desired, an adjuvant. The adjuvant may also be used for increasing immune response and may include, for example, a Freund's adjuvant (complete or incomplete), a mineral gel (aluminum hydroxide, etc.), or a surfactant (lysolecithin, etc.). An immunization protocol is known in the art and may be carried out by an arbitrary method for inducing immune response according to a host organism to be selected (Tanpakushitsu Jikken Handobukku (Protein Experiment Handbook in English), Yodosha Co., Ltd. (2003): 86-91).

In one embodiment of the present invention, "monoclonal antibody" includes the case where individual antibodies constituting a population are antibodies each corresponding to a substantially single epitope except for antibodies having a small amount of a mutation that can occur naturally. Alternatively, the individual antibodies constituting a population may be substantially identical antibodies except for antibodies having a small amount of a mutation that can occur naturally. The monoclonal antibody is highly specific and differs from an ordinary polyclonal antibody which typically comprise different antibodies corresponding to different epitopes. In addition to the specificity, the monoclonal antibody is useful because the monoclonal antibody can be synthesized from hybridoma culture that is not contaminated with other immunoglobulins. The epithet "monoclonal" may indicate the feature of being obtained from a substantially homogeneous antibody population, but does not mean that the antibody must be produced by a certain method. For example, the monoclonal antibody may be prepared by a method similar to a hybridoma method as described in "Kohler G, Milstein C., Nature. 1975 Aug. 7; 256 (5517): 495-497". Alternatively, the monoclonal antibody may be prepared by a method similar to a recombination method as described in U.S. Pat. No. 4,816,567. Alternatively, the monoclonal antibody may be isolated from a phage antibody library by use of a method similar to a technique as described in "Clackson et al., Nature. 1991 Aug. 15; 352 (6336): 624-628" or "Marks et al., J Mol Biol. 1991 Dec. 5; 222 (3): 581-597". Alternatively, the monoclonal antibody may be prepared by a method described in "Tanpakushitsu Jikken Handobukku (Protein Experiment Handbook in English), Yodosha Co., Ltd. (2003): 92-96".

For the large-scale production of the antibody, an arbitrary approach known in the art can be used. Typical examples of the construction of a large-scale antibody production system and antibody production can include the following: CHO cells are transfected with a H chain antibody expression vector and a L chain antibody expression vector, cultured using a selection reagent G418 and Zeocin, and cloned by a limiting dilution method. After the cloning, a clone stably expressing the antibody is selected by ELISA. The selected CHO cell is used in extended culture to recover a culture supernatant containing the antibody. The antibody can be purified by protein A or protein G purification from the recovered culture supernatant.

In one embodiment of the present invention, "Fv antibody" is an antibody containing an antigen recognition site. This region comprises a dimer of one heavy chain variable domain and one light chain variable domain through non-covalent binding. In this configuration, the respective three CDRs of the variable domains can act mutually to form an antigen binding site on the surface of the VH-VL dimer.

In one embodiment of the present invention, "Fab antibody" is, for example, an antibody comprising the N-terminal half of the H chain and the whole L chain disulfide-bonded at a part of the antibody, among fragments obtained by treating an antibody comprising Fab and Fc regions with a proteolytic enzyme papain. Fab can be obtained, for example, by treating the anti-FSTL1 antibody according to the embodiments of the present invention comprising Fab and Fc regions with a proteolytic enzyme papain.

In one embodiment of the present invention, "F(ab')2 antibody" is, for example, an antibody containing two sites each corresponding to Fab, among fragments obtained by treating an antibody comprising Fab and Fc regions with a proteolytic enzyme pepsin. F(ab')2 can be obtained, for example, by treating the anti-FSTL1 antibody according to the embodiments of the present invention comprising Fab and Fc regions with a proteolytic enzyme pepsin. Also, F(ab')2 can be prepared, for example, by thioether-bonding or disulfide-bonding Fab' fragments described below.

In one embodiment of the present invention, "Fab' antibody" is, for example, an antibody obtained by cleaving the disulfide bond in the hinge region of F(ab')2. Fab' can be obtained, for example, by treating F(ab')2 with a reducing agent dithiothreitol.

In one embodiment of the present invention, "scFv antibody" is an antibody comprising VH and VL linked via an appropriate peptide linker. The scFv antibody can be produced, for example, by obtaining cDNAs encoding VH and VL of the anti-FSTL1 antibody according to the embodiments of the present invention, constructing a polynucleotide encoding VH-peptide linker-VL, and integrating the polynucleotide into a vector, followed by use of cells for expression.

In one embodiment of the present invention, "diabody" is an antibody having divalent antigen binding activity. The divalent antigen binding activity may be the same antigen binding activities or may be different antigen binding activities. The diabody can be produced, for example, by constructing polynucleotides encoding scFvs such that the length of the amino acid sequence of a peptide linker is 8 or less residues, and integrating the obtained polynucleotides into a vector, followed by use of cells for expression.

In one embodiment of the present invention, "dsFv" is an antibody obtained by bonding polypeptides containing cysteine residues introduced in VH and VL, via a disulfide bond between the cysteine residues. The positions to which the cysteine residues are introduced can be selected on the basis of the conformational prediction of the antibody according to a method shown by Reiter et al. (Reiter et al., Protein Eng. 1994 May; 7 (5): 697-704).

In one embodiment of the present invention, "peptide or polypeptide having antigen binding activity" is an antibody constituted to comprise the VH or VL of the antibody, or CDR1, CDR2, or CDR3 thereof. A plurality of CDR-containing peptides can be bonded directly or via an appropriate peptide linker.

A method for producing the Fv antibody, Fab antibody, F(ab')2 antibody, Fab' antibody, scFv antibody, diabody, dsFv antibody, or peptide or polypeptide having antigen binding activity (hereinafter, also referred to as "Fv antibody, etc.") described above is not particularly limited. For example, DNA encoding a region in the Fv antibody, etc. for the anti-FSTL1 antibody according to the embodiments of the present invention is integrated into a vector for expression, and the Fv antibody, etc. can be produced using cells for expression. Alternatively, the Fv antibody, etc. may be produced by a chemical synthesis method such as Fmoc method (fluorenylmethyloxycarbonyl method) or tBOC method (t-butyloxycarbonyl method). The antigen binding fragment according to one embodiment of the present invention may be one or more of the Fv antibody, etc.

In one embodiment of the present invention, "chimeric antibody" is, for example, an antibody comprising the variable regions of an antibody of an organism species linked to the constant regions of an antibody of an organism species different therefrom, and can be constructed by a gene recombination technique. A mouse-human chimeric antibody can be prepared by a method described in, for example, "Roguska et al., Proc Natl Acad Sci USA. 1994 Feb. 1; 91 (3): 969-973". In a basic method for preparing the mouse-human chimeric antibody, for example, mouse leader sequences and variable region sequences present in cloned cDNA are linked to human antibody constant region-encoding sequences already present in an expression vector for mammalian cells. Alternatively, mouse leader sequences and variable region sequences present in cloned cDNA may be linked to human antibody constant region-encoding sequences and then ligated with an expression vector for mammalian cells. Fragments of human antibody constant regions can be arbitrary H and L chain constant regions of a human antibody. Examples thereof can include Cyl, Cy2, Cy3, and Cy4 for human H chains and Cλ or Cκ for L chains.

In one embodiment of the present invention, "humanized antibody" is, for example, an antibody that has one or more CDRs derived from a non-human species and framework regions (FRs) derived from a human immunoglobulin, and further, human immunoglobulin-derived constant regions, and binds to a desired antigen. The antibody humanization can be carried out by use of various approaches known in the art (Almagro et al., Front Biosci. 2008 Jan. 1; 13: 1619-1633). Examples thereof include CDR grafting (Ozaki et al., Blood. 1999 Jun. 1; 93 (11): 3922-3930), re-surfacing (Roguska et al., Proc Natl Acad Sci USA. 1994 Feb. 1; 91 (3): 969-973), and FR shuffle (Damschroder et al., Mol Immunol. 2007 April; 44 (11): 3049-3060. Epub 2007 Jan. 22). In order to alter (preferably, improve) antigen binding, an amino acid residue in a human FR region may be substituted by a corresponding residue from a CDR donor antibody. This FR substitution can be carried out by a method well known in the art (Riechmann et al., Nature. 1988 Mar. 24; 332 (6162): 323-327). For example, a FR residue important for antigen binding may be identified by the interaction modeling of CDR and FR residues. Alternatively, an abnormal FR residue may be identified at a particular position by sequence comparison. In a preferred embodiment, the humanized antibody may be produced on the basis of the report of Matsuda et al. Molecular Immunology 43 (2006) 634-642.

In a preferred embodiment of the present invention, a humanized antibody having the H chain FR1, FR2, FR3, and FR4 (SEQ ID NOs: 926, 928, 930, and 932, respectively) and L chain FR1, FR2, FR3, and FR4 (SEQ ID NOs: 942, 944, 946, and 948, respectively) of H(2)-L(1) can be used, though the humanized antibody of the present invention is not limited thereto. As for the full-length sequences of the humanized antibody, the full-length sequence of the H(1) heavy chain in this humanized antibody is represented by SEQ ID NOs: 949 and 950 (which represent nucleic acid and amino acid sequences, respectively) for IgG1 type and represented by SEQ ID NOs: 955 and 956 (which represent nucleic acid and amino acid sequences, respectively) for IgG4 type. The full-length sequence of the H(2) heavy chain is represented by SEQ ID NOs: 951 and 952 (which represent nucleic acid and amino acid sequences, respectively) for IgG1 type and represented by SEQ ID NOs: 957 and 958 (which represent nucleic acid and amino acid sequences, respectively) for IgG4 type. The full-length sequence of the H(3) heavy chain is represented by SEQ ID NOs: 953 and 954 (which represent nucleic acid and amino acid sequences, respectively) for IgG1 type and represented by SEQ ID NOs: 959 and 960 (which represent nucleic acid and amino acid sequences, respectively) for IgG4 type. The full-length sequence of the L(1) light chain is represented by SEQ ID NOs: 961 and 962 (which represent nucleic acid and amino acid sequences, respectively). The full-length sequence of the L(2) light chain is represented by SEQ ID NOs: 1003 and 1004 (which represent nucleic acid and amino acid sequences, respectively). The full-length sequence of the L(3) light chain is represented by SEQ ID NOs: 1005 and 1006 (which represent nucleic acid and amino acid sequences, respectively). Although not wishing to be bound by any theory, activity higher by an order of magnitude was observed in H(2)-L(1) than H(3)-L(1) (frameworks of H(3):

SEQ ID NOs: 934, 936, 938, and 940, respectively) and H(1)-L(1) (frameworks of H(1): SEQ ID NOs: 918, 920, 922, and 924, respectively).

In one embodiment of the present invention, "human antibody" is, for example, an antibody in which a region comprising heavy chain variable and constant regions and light chain variable and constant regions constituting the antibody is derived from a gene encoding a human immunoglobulin. A typical preparation method includes a transgenic mouse method for human antibody preparation, a phage display method, or the like. In the transgenic mouse method for human antibody preparation, a human antibody having diverse antigen binding ability instead of a mouse antibody is produced by transferring a functional human Ig gene to a mouse in which endogenous Ig has been knocked down. A human monoclonal antibody can be obtained by a conventional hybridoma method by further immunizing this mouse. This preparation can be performed by a method described in, for example, "Lonberg et al., Int Rev Immunol. 1995; 13 (1): 65-93". The phage display method is typically a system that allows a fibrous phage such as M13 or T7, an E. coli virus, to express a foreign gene as a fusion protein at the N terminus of its coat protein (g3p, g10p, etc.) so as not to lose the infectivity of the phage. This preparation can be performed by a method described in, for example, "Vaughan et al., Nat Biotechnol. 1996 March; 14 (3): 309-314".

The antibody may be prepared by grafting the heavy chain CDRs or light chain CDRs of the anti-FSTL1 antibody according to the embodiments of the present invention to an arbitrary antibody according to CDR grafting (Ozaki et al., Blood. 1999 Jun. 1; 93 (11): 3922-3930). Alternatively, the antibody can be obtained by ligating DNAs encoding the heavy chain CDRs or light chain CDRs of the anti-FSTL1 antibody according to the embodiments of the present invention, and DNAs encoding the regions, except for heavy chain CDRs or light chain CDRs, of a publicly known antibody derived from a human or a non-human organism with a vector according to a method known in the art, followed by expression using publicly known cells. In this respect, in order to enhance the action efficiency of the anti-FSTL1 antibody on the target antigen, the regions except for heavy chain CDRs or light chain CDRs may be optimized by use of a method known in the art (e.g., a method of randomly mutating amino acid residues of antibodies and screening for an antibody having high reactivity, or a phage display method). Also, FR regions may be optimized by use of, for example, FR shuffle (Damschroder et al., Mol Immunol. 2007 April; 44 (11): 3049-3060, Epub 2007 Jan. 22) or a method for substituting vernier zone amino acid residues or packaging residues (Japanese Patent Laid-Open No. 2006-241026; and Foote et al., J Mol Biol. 1992 Mar. 20; 224 (2): 487-499).

In one embodiment of the present invention, "heavy chain" is typically a main constituent of a full-length antibody. The heavy chain is usually disulfide-bonded or non-covalently bonded to a light chain. The N-terminal domain of the heavy chain has a region called variable region (VH) whose amino acid sequence is not constant even among antibodies of the same species and the same class. In general, VH is known to largely contribute to specificity and affinity for an antigen. For example, "Reiter et al., J Mol Biol. 1999 Jul. 16; 290 (3): 685-98" states that a molecule of only VH was prepared and consequently bound to an antigen specifically and with high affinity. "Wolfson W, Chem Biol. 2006 December; 13 (12): 1243-1244" states that among camel antibodies, there exist antibodies lacking light chains and having only heavy chains.

In one embodiment of the present invention, "CDRs (complementarity determining regions)" are regions that come in actual contact with an antigen and form a binding site in the antibody. In general, CDRs are positioned on Fv (comprising a heavy chain variable region variable region (VH) and a light chain variable region (VL)) of the antibody. In general, CDRs include CDR1, CDR2, and CDR3 each consisting of approximately 5 to 30 amino acid residues. Particularly, heavy chain CDRs are known to contribute to the binding of the antibody to the antigen. Among CDRs, CDR3 is known to make the highest contribution to the binding of the antibody to the antigen. For example, "Willy et al., Biochemical and Biophysical Research Communications Volume 356, Issue 1, 27 Apr. 2007, Pages 124-128" states that the binding ability of an antibody was enhanced by altering heavy chain CDR3. Fv regions other than CDRs are called framework regions (FRs) which consist of FR1, FR2, FR3, and FR4, and are relatively well conserved among antibodies (Kabat et al., "Sequence of Proteins of Immunological Interest", US Dept. Health and Human Services, 1983). In short, a factor that characterizes the reactivity of the antibody is CDRs, particularly, heavy chain CDR.

There are a plurality of reports on the definition of CDRs and methods for determining the positions thereof. For example, the definition of Kabat (Sequences of Proteins of Immunological Interest, 5th ed., Public Health Service, National Institutes of Health, Bethesda, Md. (1991)) or the definition of Chothia (Chothia et al., J. Mol. Biol., 1987; 196: 901-917) may be adopted. In one embodiment of the present invention, the definition of Kabat is adopted as a suitable example, though the definition of CDRs is not necessarily limited thereto. In some cases, CDRs may be determined in consideration of both the definition of Kabat and the definition of Chothia. For example, overlapping moieties of CDRs according to the respective definitions or moieties including both CDRs of the respective definitions may be used as CDRs. Specific examples of such a method include the method of Martin et al. using Oxford Molecular's AbM antibody modeling software (Proc. Natl. Acad. Sci. USA, 1989; 86: 9268-9272), which is a combined method of the definition of Kabat and the definition of Chothia. A mutant that may be used in the present invention can be produced using such information on CDRs. Such an antibody mutant can be produced such that the substitution, addition, or deletion of 1 or several (e.g., 2, 3, 4, 5, 6, 7, 8, 9, and 10) amino acids is contained in a framework of the original antibody whereas no mutation is contained in the CDRs.

In the present specification, "antigen" refers to an arbitrary substrate to which an antibody molecule is capable of specifically binding. In the present specification, "immunogen" refers to an antigen capable of initiating lymphocyte activation resulting in antigen-specific immune response. In the present specification, "epitope" or "antigen determinant" refers to a site in an antigen molecule to which an antibody or a lymphocyte receptor binds. A method for determining the epitope is well known in the art. Those skilled in the art can determine such an epitope by use of such a well-known technique conventionally used, provided that the primary sequence of a nucleic acid or an amino acid is provided. It is understood that an antibody having a sequence different from that of the antibody of the present invention can be similarly used as long as the epitope for the antibody is the same as that for the antibody of the present invention.

It is understood that an antibody having any specificity may be used as the antibody used herein as long as false positivity is decreased. Thus, the antibody used in the present invention may be a polyclonal antibody or may be a monoclonal antibody.

In the present specification, "means" refers to a unit that can serve as an arbitrary tool to achieve a certain purpose (e.g., detection, diagnosis, and treatment). In the present specification, particularly, "selectively recognizing means" refers to means that can recognize a certain subject distinctively from others.

"Malignant tumor" used herein includes, for example, tumor that is developed by the mutation of normal cells. The malignant tumor may be developed from every organ or tissue throughout the body. The malignant tumor is used herein interchangeably with "cancer" unless otherwise specified. This malignant tumor includes one or more selected from the group consisting of, for example, lung cancer, esophageal cancer, stomach cancer, liver cancer, pancreatic cancer, kidney cancer, adrenal cancer, bile duct cancer, breast cancer, colorectal cancer, small intestine cancer, ovary cancer, uterine cancer, bladder cancer, prostate cancer, ureter cancer, renal pelvis cancer, ureter cancer, penis cancer, testis cancer, brain tumor, cancer of the central nervous system, cancer of the peripheral nervous system, head and neck cancer, glioma, glioblastoma multiforme, skin cancer, melanoma, thyroid gland cancer, salivary gland cancer, malignant lymphoma, carcinoma, sarcoma, leukemia, and malignant blood tumor. In this context, the ovary cancer includes, for example, ovarian serous adenocarcinoma or ovarian clear cell adenocarcinoma. The uterine cancer includes, for example, endometrial cancer or uterine cervical cancer. The head and neck cancer includes, for example, mouth cancer, throat cancer, larynx cancer, nasal cavity cancer, sinus cancer, salivary gland cancer, or thyroid gland cancer. The lung cancer includes, for example, non-small cell lung cancer or small-cell lung cancer. The malignant tumor may be FSTL1-positive.

In the present specification, "metastasis" refers to the process in which cancer spreads or travels from a primary focus to other regions of the body to develop a similar cancerous lesion at a new site. "Metastatic" or "metastasizing" cell is a cell that loses adhesive contact with adjacent cells and travels from a primary focus of the disease through blood flow or lymph to invade a neighboring structure of the body. In the present specification, the term "metastasis" preferably includes, but is not limited to, metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the metastasis of the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, "bone metastasis" means metastasis of cancer to bone and includes bone metastasis of an arbitrary origin. The term "bone metastasis" preferably includes, but is not limited to, bone metastasis of the cancer described herein, more preferably solid cancer, still more preferably cancer selected from the group consisting of cancers of the breast, the heart, the lung, the small intestine, the large intestine, the spleen, the kidney, the bladder, the head and neck, the ovary, the prostate, the brain, the pancreas, the skin, bone, thymus, the uterine, the testis, the uterine cervix, and/or the liver. According to the present invention, the term "bone metastasis" also preferably includes a bone lesion, preferably an osteolytic and/or osteogenic bone lesion, more preferably an osteolytic bone lesion, still more preferably a bone lesion of myeloma, malignant myeloma, and/or multiple myeloma, particularly an osteolytic bone lesion of myeloma, malignant myeloma, and/or multiple myeloma. According to the present invention, the term "bone metastasis" also preferably includes a bone lesion of Waldenstrom's disease, preferably an osteolytic and/or osteogenic bone lesion of Waldenstrom's disease, more preferably an osteolytic bone lesion of Waldenstrom's disease. The bone metastasis according to the present invention more preferably includes bone metastasis of cancer selected from the group consisting of breast cancer, lung cancer, large intestine cancer, colorectal cancer, kidney cancer, bladder cancer, head and neck cancer, ovary cancer, prostate cancer, brain cancer, pancreatic cancer, skin cancer, thymus cancer, uterine cancer, testis cancer, uterine cervical cancer, and liver cancer.

In the present specification, the term "mesenchymal stem cells" and its abbreviation "MSCs" can be used interchangeably. This term refers to pluripotent stem cells that have the ability to self-renew and possess the ability to differentiate into mesenchymal cells such as osteoblasts, chondrocytes, and adipocytes, and typically means, in a broad sense, a population of stem cells that grow in an undifferentiated state and are capable of differentiating into all or some of osteoblasts, chondroblasts, and lipoblasts, or progenitor cells thereof. In organisms, the mesenchymal stem cells are present with low frequency in bone marrow, peripheral blood, cord blood, fat tissues, and the like. The mesenchymal stem cells can be isolated or purified from these tissues by a publicly known method, and its main molecular index is CD45 expression negativity. "Isolation" or "purification" means the operation of artificially placing an intended component in a state different from a naturally occurring state, for example, the operation of removing components other than the intended component from a naturally occurring state. For example, human mesenchymal stem cells can be isolated from bone marrow fluid by a Percoll gradient method (Hum. Cell, vol. 10, p. 45-50, 1997). Alternatively, the human mesenchymal stem cells can be isolated by the culture and subculture of hematopoietic stem cells or the like after bone marrow puncture (Journal of Autoimmunity, 30 (2008) 163-171).

Mesenchymal stem cells induce or enhance immune defect such as immunosuppression or immunodeficiency. Activation is essential for acquiring this activity. MSCs increasing in number in association with cancer are considered to be "activated MSCs" after activation by various in vivo agents. In the present specification, such MSCs are also referred to as "activated mesenchymal stem cells" or "activated MSCs". Specifically, there exists the mechanism of immune defect, including, for example, the case where cells originally having immunosuppressive activity (e.g., regulatory T cells, tolerogenic dendritic cells, regulatory dendritic cells, and myeloid-derived suppressor cells) grow so that immunosuppressive activity is comprehensively strengthened, the case where cells normally having no activity (i.e., progenitor cells) acquire immunosuppressive properties to increase the rate of conversion to their cells having immunosuppressive activity (e.g., regulatory T cells, tolerogenic dendritic cells, regulatory dendritic cells, and myeloid-derived suppressor cells) so that immunosuppressive activity is strengthened, and induction of exhausted T cells that fall into an immunocompromised status that fails to exert immune functions. FSTL1 is considered to control the mechanism directly and/or indirectly via the growth of activated MSCs, etc. (Immunology and Cell Biology 91: 12-18, 2013). Although not wishing to be bound by any theory, the antibody FSTL1 antibody, etc. of the present invention can inhibit the induction or enhancement of immunosuppression by these MSCs, and immunodeficiency, etc. and can thereby mitigate immunosuppression responsible for the aggravation of cancer. Hence, remarkable prophylactic or therapeutic effects on cancer can be achieved. As for the induction or enhancement of MSCs inducing these cells for immune defect such as immunosuppressive cells and/or immunodeficient cells, it is considered that the present invention can inhibit an upstream region thereof and can therefore mitigate the whole mechanism of immune defect such as immunosuppression and/or immunodeficiency. Thus, more effective treatment is probably achieved.

The suppression of induction or growth of mesenchymal stem cells (MSCs) (including cancer-associated MSCs and activated MSCs) can be confirmed, for example, by examining the inhibition of differentiation of MSCs into adipocytes, for example, as shown in FIGS. 103 and 104. Although not wishing to be bound by any theory, FSTL1 is considered to increase the number of immunosuppressive MSCs themselves and/or to strengthen suppressive activity against other cells.

In the present specification, "enhancement" of "immunosuppression" (the term "immunosuppression" is also referred to as immunosuppressive properties, immunoregulation, immunoregulatory properties, immunomodulation, immunomodulatory properties, immunomodification, and immunomodifying properties, and these terms are used interchangeably in the art) conceptually encompasses enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells) and refers to consequent enhancement of immunosuppression. Thus, it is understood that the enhancement of immunosuppression conceptually includes enhancement of the ability of immunosuppressive cells and expansion of immunosuppressive cells (including enhancement of the immunosuppressive activity of immunosuppressive cells and/or promotion of growth of immunosuppressive cells and/or differentiation of non-immunosuppressive cells into immunosuppressive cells). The manner of induction of immunosuppressive cells by MSC cells encompasses promotion of differentiation into immunosuppressive cells such as regulatory T cells, enhancement of the immunosuppressive activity of immunosuppressive cells such as regulatory T cells, and growth of immunosuppressive cells such as regulatory T cells, and encompasses consequent enhancement of immunosuppressive properties.

In the present specification, "immunosuppressive cells" (the term "immunosuppressive" is also referred to as immunoregulatory, immunomodulatory, and immunomodifying, and these terms are used interchangeably in the art) refer to cells having a function of suppressing immune competence. Typical examples thereof can include, but are not limited to, regulatory T cells, regulatory dendritic cells, tolerogenic dendritic cells, and myeloid-derived suppressor cells.

It is known that not only immunosuppression as described above but immunodeficiency plays a role in the mechanism underlying the disruption of immune functions by mesenchymal stem cells (MSCs). The immunosuppression and the immunodeficiency are collectively referred to as "immune defect".

In the present specification, "immunodeficiency" refers to a state in which the normal immune mechanism has been damaged due to a lack or dysfunction of a portion or some of cellular elements constituting the immune system. Pathological conditions caused thereby are collectively referred to as immunodeficiency diseases. The immunodeficiency diseases are broadly divided into primary and secondary diseases. The former is mainly ascribable to congenital genetic abnormality, and the latter refers to diseases caused by physicochemical factors such as drugs or X-ray or external environmental factors such as viral infection or nutritional status. The damaged site is reportedly attributed to various causes such as dysfunction of a B cell zone such as antibody production, abnormality in T cell zone involved in cellular immunity, and impaired functions of cells of the complement system or the phagocytic system (e.g., a phagocytic function). "Exhausted T cells" serve as a main index for immunodeficiency. The anti-PD-1 antibody, etc. is also developed as an antibody that can inhibit this "exhaustion/incompetence".

In the present specification, "immune defect" conceptually refers to immunosuppression and immunodeficiency in combination. When the immune defect occurs, low immunogenic cancer cells more advantageous for survival grow selectively (an equilibrium phase (state in which cancer cells neither disappear nor grow through their interaction with immunocytes) is shifted to an escape phase). It is considered that the immunogenicity of cancer is reduced in a short time from the end of the equilibrium phase through the escape phase. T cells supposed to kill cancer cells reportedly play this role paradoxically.

In the present specification, "exhaustion" means that various co-suppressive molecules such as PD-1, CTLA4, and TIM3 (mentioned later) are induced on T cells due to long-term exposure to an antigen so that the T cells fall into a dysfunctional state. This is considered to be responsible for inducing the irresponsiveness of T cells in chronic infection or cancer. In the present specification, such T cells are referred to as "exhausted T cells".

The anti-PD-1 antibody, etc. is also developed as an antibody that can inhibit this "exhausted" state and "immunodeficiency". Thus, the anti-FSTL1 antibody used in the present invention can inhibit (growth or development of) exhausted T cells as shown in Examples, and is therefore expected to be able to inhibit such "exhausted" state and "immunodeficiency". Thus, it is understood that "immune defect" can be inhibited.

In the present specification, "immune-related cells" refer to arbitrary cells of the immune system that undergo immunosuppression, dysfunction, etc. In the present specification, it is understood that "acquirement and/or enhancement of immunosuppressive activity by or of immune-related cells" typically include, for example, growth of regulatory T cells, differentiation into regulatory T cells, growth of regulatory dendritic cells, differentiation into regulatory dendritic cells, growth of tolerogenic dendritic cells, differentiation into tolerogenic dendritic cells, growth of myeloid-derived suppressor cells, differentiation into myeloid-derived suppressor cells, and expansion of exhausted T cells.

In the present specification, "test subject" refers to a subject to be diagnosed, detected, or treated, for example, according to the present invention (e.g., an organism such as a human, or cells, blood, serum, etc. separated from the organism).

In the present specification, "sample" refers to an arbitrary substance obtained from a test subject or the like and includes, for example, serum. Those skilled in the art can appropriately select a preferred sample on the basis of the description of the present specification.

In the present specification, "agent" is used in a broad sense and may be any substance or other factor (e.g., energy such as light, radioactivity, heat, or electricity) as long as the intended purpose can be attained. Examples of such a substance include, but are not limited to, proteins, polypeptides, oligopeptides, peptides, polynucleotides, oligonucleotides, nucleotides, nucleic acids (including e.g., DNA such as cDNA and genomic DNA, and RNA such as mRNA), polysaccharides, oligosaccharides, lipids, organic small molecules (e.g., hormones, ligands, signaling substances, organic small molecules, molecules synthesized by combinatorial chemistry, and pharmaceutically available small molecules (e.g., low-molecular ligands)), and complex molecules thereof. Typical examples of the agent specific for a polynucleotide include, but are not limited to, a polynucleotide having complementarity with given sequence homology (e.g., 70% or higher sequence identity) to the sequence of the polynucleotide, and a polypeptide such as a transcriptional factor binding to a promoter region. Typical examples of the agent specific for a polypeptide include, but are not limited to, an antibody specifically directed to the polypeptide, or a derivative thereof, or an analog thereof (e.g., a single-chain antibody), a specific ligand or receptor when the polypeptide is a receptor or a ligand, and a substrate when the polypeptide is an enzyme.

In the present specification, "diagnosis" means that various parameters associated with a disease, a disorder, a condition (e.g., malignant tumor), or the like in a test subject are identified to determine the current status or future of such a disease, disorder, or condition. The state within the body can be examined by use of the method, the apparatus, or the system of the present invention. Various parameters such as the disease, disorder, or condition in the test subject, a procedure to be administered, or a formulation or a method for prevention can be selected using such information. In the present specification, "diagnosis" refers to the diagnosis of the current status in a narrow sense and includes "early diagnosis", "predictive diagnostics", "pre-diagnosis", and the like in a broad sense. The diagnosis method of the present invention is industrially useful because the method can utilize materials separated from the body, as a rule, and can be carried out with no help from healthcare professionals such as physicians. In the present specification, particularly, "predictive diagnostics, pre-diagnosis, or diagnosis" is also referred to as "support" in order to clarify feasibility with no help from healthcare professionals such as physicians.

In the present specification, the term "prognosis" means prediction of the possibility of death or progression attributed to cancer, such as recurrence, metastatic spread, and drug resistance of a neoplastic disease such as malignant tumor (e.g., ovary cancer). Thus, in the present specification, "good prognosis" means that recurrent cancer originating from the primary cancer is absent beyond a given period (e.g., 4 years) after cancer tissue resection. "Poor prognosis" means that recurrent cancer originating from the primary cancer is present beyond a given period (e.g., 4 years) after cancer tissue resection. A prognosis factor is a variable regarding the natural course of malignant tumor and influences the rate of recurrence and outcome of a patient that has suffered from malignant tumor. A clinical index related to the worsening of prognosis includes, for example, lymph node metastasis and high-grade tumor. The prognosis factor is often used for classifying patients into subgroups having different basic risks of recurrence. Accordingly, the expression of the FSTL1 of the present invention can be used as a prognosis factor. In the present specification, the term "prediction" means the possibility that a patient has a particular clinical outcome, regardless of whether to be good or poor, after removal of primary tumor. Thus, the FSTL1 of the present invention can be used as a marker for poor prognosis. A treatment method can be determined by selecting a treatment method optimal for a particular patient by clinical use of the prediction method of the present invention. The prediction method of the present invention is beneficial means for prediction provided that there is the possibility that a patient has good response to a treatment regimen, for example, surgical intervention. The prediction can involve a prognosis factor.

In the present specification, "detecting drug (agent)" or "testing drug (agent)" refers to every agent that permits detection or test of a targeted subject in a broad sense.

In the present specification, "diagnostic drug (agent)" refers to every agent that permits diagnosis of a targeted condition (e.g., a disease such as malignant tumor) in a broad sense.

In the present specification, "treatment" of a certain disease or disorder (e.g., malignant tumor) refers to the prevention of aggravation of such a disease or disorder, preferably status quo, more preferably alleviation, further preferably resolution, of such a disease or disorder, after occurrence of such a condition. The treatment includes capability of exerting a symptom-ameliorating effects or prophylactic effects on a disease in a patient or one or more symptoms associated with the disease. Appropriate treatment based on pre-diagnosis is referred to as "companion treatment". A diagnostic drug therefor is also referred to as "companion diagnostic drug".

In the present specification, "therapeutic drug (agent)" refers to every agent that permits treatment of a targeted condition (e.g., a disease such as malignant tumor) in a broad sense. In one embodiment of the present invention, "therapeutic drug" may be a pharmaceutical composition comprising an active ingredient and one or more pharmacologically acceptable carriers. The pharmaceutical composition can be produced, for example, by mixing the active ingredient with the carriers and performing an arbitrary method known in the pharmaceutical technical field. The therapeutic drug is not limited by the type of usage as long as the therapeutic drug is used for treatment. The therapeutic drug may be the active ingredient alone or may be a mixture of the active ingredient and an arbitrary ingredient. The carriers are not particularly limited by their forms and may be, for example, solids or liquids (e.g., buffer solutions). The therapeutic drug for malignant tumor includes a drug for use in the prevention of malignant tumor (prophylactic drug) or a growth suppressor of malignant tumor cells.

In the present specification, "prevention" of a certain disease or disorder (e.g., malignant tumor) refers to protection against occurrence of such a condition before occurrence of this condition. Diagnosis is conducted using the agent of the present invention, and the prevention of, for example, malignant tumor, or measures for the prevention can be carried out using the agent of the present invention according to the need.

In the present specification, "prophylactic drug (agent)" refers to every agent that permits prevention of a targeted condition (e.g., a disease such as malignant tumor) in a broad sense.

In the present specification, "interaction" when two substances are mentioned means that force (e.g., intermolecular force (van der Waals attraction), a hydrogen bond, and hydrophobic interaction) works between one of the substances and the other substance. Usually, two substances that have interacted with each other are in an associated or bound state. The detection, the testing, and the diagnosis of the present invention can be achieved through the use of such interaction.

The term "binding" used herein means the physical interaction or chemical interaction between two substances or between their combinations. The binding includes an ionic bond, a non-ionic bond, a hydrogen bond, van der Waals binding, hydrophobic interaction, and the like. The physical interaction (binding) can be direct or indirect. The indirect binding is mediated by or attributed to the effects of another protein or compound. The direct binding refers to interaction that is neither mediated by nor attributed to the effects of another protein or compound and involves no other substantial chemical intermediates.

Thus, in the present specification, "agent" (or a detecting agent, etc.) "specifically" interacting with (or binding to) a biological agent such as a polynucleotide or a polypeptide encompasses an agent whose affinity for the biological agent such as the polynucleotide or the polypeptide is typically equivalent to or higher, preferably significantly (e.g., statistically significantly) higher, than its affinity for other unrelated polynucleotides or polypeptides (particularly, having less than 30% identity). Such affinity can be measured by, for example, hybridization assay or binding assay.

In the present specification, the phrase "first substance or agent "specifically" interacts with (or binds to) a second substance or agent" means that the first substance or agent interacts with (or binds to) the second substance or agent with higher affinity than that for substances or agents other than the second substance or agent (particularly, other substances or agents present in a sample containing the second substance or agent). Examples of the specific interaction (or binding) between substances or agents include, but are not limited to: the reactions between nucleic acids or proteins, such as hybridization for the nucleic acids, and antigen-antibody reaction and enzyme-substrate reaction for the proteins; and protein-lipid interaction and nucleic acid-lipid interaction. Thus, in the case where both of the substances or agents are nucleic acids, the "specific interaction" of the first substance or agent with the second substance or agent encompasses the case where the first substance or agent has complementarity to at least a portion of the second substance or agent. Alternatively, in the case where both of the substances or agents are proteins, examples of the "specific" interaction (or binding) of the first substance or agent with (or to) the second substance or agent include, but are not limited to, interaction through antigen-antibody reaction, interaction through receptor-ligand reaction, and enzyme-substrate interaction. In the case where two types of substances or agents comprise proteins and nucleic acids, the "specific" interaction (or binding) of the first substance or agent with (or to) the second substance or agent encompasses the interaction (or binding) between an antibody and its antigen. An analyte in a sample can be detected or quantified through the use of the reaction of such specific interaction or binding.

In the present specification, "detection" or "quantification" of polynucleotide or polypeptide expression can be achieved by use of an appropriate method including, for example, mRNA assay and immunological assay methods involving binding to or interaction with a detecting agent, a testing agent, or a diagnostic agent. Examples of the molecular biological assay method include Northern blot, dot blot, and PCR. Examples of the immunological assay method include methods such as ELISA using microtiter plates, RIA, fluorescence immunoassay, luminescence immunoassay (LIA), immunoprecipitation (IP), single radial immunodiffusion (SRID), turbidimetric immunoassay (TIA), Western blot, and immunohistological staining. Examples of the quantification method include ELISA and RIA. The detection or the quantification may be performed by a gene analysis method using an array (e.g., a DNA array and a protein array). The DNA array is broadly reviewed in (Gakken Medical Shujunsha Co., Ltd. ed., Cell Engineering, Suppl., "DNA microarray and latest PCR methods"). The protein array is described in detail in Nat Genet. 2002 December; 32 Suppl: 526-532. Examples of the gene expression analysis method include, but are not limited to, RT-PCR, RACE, SSCP, immunoprecipitation, two-hybrid systems, and in vitro translation, in addition to those mentioned above. Such an additional analysis method is described in, for example, Genomu Kaiseki Jikken Ho (Experimental Methods for Genomic Analysis in English), Nakamura Lab Manual, Yusuke Nakamura, ed., Yodosha Co., Ltd. (2002), the description of which is incorporated herein by reference in its entirety.

In the present specification, "expression level" refers to the amount of a polypeptide or mRNA, etc. expressed in intended cells, tissues, or the like. Examples of such an expression level include the expression level at the protein level of the polypeptide of the present invention evaluated by any appropriate method including an immunological assay method such as ELISA, RIA, fluorescence immunoassay, Western blot, or immunohistological staining using the antibody of the present invention, and the expression level at the mRNA level of the polypeptide of the present invention evaluated by any appropriate method including a molecular biological assay method such as Northern blot, dot blot, or PCR. "Change in expression level" means increase or decrease in the expression level at the protein or mRNA level of the polypeptide of the present invention evaluated by any appropriate method including the immunological assay method or molecular biological assay method described above. The expression level of a certain marker can be measured to thereby variously conduct detection or diagnosis based on the marker.

In the present specification, "decrease" or "suppression", or its synonym of activity or an expression product (e.g., a protein and a transcript (RNA, etc.)) refers to decrease in the amount, quality, or effect of the particular activity, transcript, or protein, or decreasing activity thereagainst. In the case where the decrease results in "disappearance", the decrease means that the activity, the expression product, etc. becomes less than the detection limit, and is also particularly referred to as "disappearance". In the present specification, "disappearance" is encompassed by "decrease" or "suppression".

In the present specification, "increase" or "activation", or its synonym of activity or an expression product (e.g., a protein and a transcript (RNA, etc.)) refers to increase in the amount, quality, or effect of the particular activity, transcript, or protein, or increasing activity thereagainst.

In the present specification, "in vivo" refers to the inside of a living body. In a particular context, "in vivo" refers to a position at which an intended substance should be located.

In the present specification, "in vitro" refers to a state in which a portion of a living body is extracted or liberated to the "outside of the living body" (e.g., into a test tube) for various studies. This term makes a contrast with the term "in vivo".

In the present specification, "ex vivo" refers to a series of operations when a certain procedure is performed outside the body and the resultant is intended to be then brought back to the body. In the present invention as well, an embodiment is possible in which cells present in a living body are treated with the agent of the present invention and then brought back to the patient.

In the present specification, "kit" usually refers to a unit by which parts to be provided (e.g., a testing drug, a diagnostic drug, a therapeutic drug, an antibody, a label, and a written explanation) are provided in two or more divided compartments. This kit form is preferred when the parts should not be provided as a mixture for stability or the like and are intended to be mixed immediately before use to provide a preferred composition. For such a kit, it is advantageous to comprise, preferably, an instruction manual or a written explanation that describes how to use the parts to be provided (e.g., a testing drug, a diagnostic drug, and a therapeutic drug or how to treat reagents. In the present specification, in the case of using the kit as a reagent kit, the kit usually comprises an instruction manual or the like that describes how to use a testing kit, a diagnostic drug, a therapeutic drug, an antibody, etc.

In the present specification, "instruction manual" is a statement that explains a method used in the present invention to physicians or other users. This instruction manual describes words providing instructions for the detection method of the present invention, how to use a diagnostic drug, or the administration of a medicament or the like. Also, the instruction manual may describe words providing instructions for oral administration or administration to the esophagus (e.g., by injection) as an administration route. This instruction manual is prepared according to a format specified by regulatory authorities of a country (e.g., Ministry of Health, Labour and Welfare for Japan and Food and Drug Administration (FDA) for the U.S.A) where the present invention is executed, and stipulates that approval by the regulatory authorities has been received. The instruction manual is a so-called package insert and is usually provided in a paper version, though the instruction manual is not limited thereto. The instruction manual may be provided in the form of, for example, an electronic medium (e.g., homepage provided by the Internet, and e-mail).

Preferred Embodiments

Hereinafter, preferred embodiments of the present invention will be described. It is understood that the embodiments provided below are given for well understanding the present invention, and the scope of the present invention should not be limited to the description below. Thus, it is evident that those skilled in the art can appropriately make change or modification within the scope of the present invention in light of the description of the present specification. It is also understood that the following embodiments of the present invention can each be used alone or can be used in combination.

(Anti-FSTL1 Antibody)

In one aspect, the present invention provides an anti-FSTL1 antibody or a fragment or functional equivalent thereof (also collectively referred herein to as "anti-FSTL1 antibody, etc." or "antibody, etc. of the present invention"), wherein the antibody recognizes an epitope in a region selected from the group consisting of amino acid positions 48 to 100, 148 to 170 or 148 to 162, 193 to 228 or 193 to 216, 205 to 228, and 233 to 289 or 272 to 289 of SEQ ID NO: 759 (amino acid sequence of human FSTL1). In a preferred embodiment, the antibody recognizes an epitope in a region of amino acid positions 148 to 162 or 272 to 289 of SEQ ID NO: 759 (amino acid sequence of human FSTL1).

For the antibody according to the present invention, the epitope can correspond to a region of consecutive or non-consecutive 5 or more amino acids, 6 or more amino acids, 7 or more amino acids, 8 or more amino acids, 9 or more amino acids, 10 or more amino acids, 11 or more amino acids, or 12 or more amino acids in the region concerned, or a combination thereof.

In a preferred embodiment, the antibody for the anti-FSTL1 antibody of the present invention or the fragment or functional equivalent thereof recognizes an epitope in a region selected from the group consisting of amino acid positions 48 to 100, 148 to 162, 205 to 228, and 272 to 289 of SEQ ID NO: 758 (amino acid sequence of human FSTL1). These epitopes include those for which drug efficacy has been confirmed in animal tests. It is understood that #6-55, #7-34, and #13 recognize the 148-162 site. It is also understood that #5-2, #5-3, #5-8, #5-10, #5-43, #8-1, #8-4, #8-6, and #8-8 recognize amino acid positions 272 to 289. It is understood that #7 and #10 recognize amino acid positions 205 to 228. It is understood that #22 recognizes amino acid positions 193 to 216. It is understood that #33 recognizes amino acid positions 48 to 100. Further preferably, the antibody for the anti-FSTL1 antibody of the present invention or the fragment or functional equivalent thereof recognizes an epitope in a region selected from the group consisting of amino acid positions 148 to 162 and 205 to 228 of SEQ ID NO: 758 (amino acid sequence of human FSTL1). These epitopes include those recognized by antibodies confirmed to have stronger activity. In another preferred embodiment, the antibody recognizes an epitope in a region of amino acid positions 48 to 100, 148 to 162, or 205 to 228 of SEQ ID NO: 759 (amino acid sequence of human FSTL1). Although not wishing to be bound by any theory, these epitopes include those for which drug efficacy has been confirmed in in vitro or in vivo tests.

In an alternative embodiment, the antibody for the anti-FSTL1 antibody of the present invention or the fragment or functional equivalent thereof has particular CDR. Alternatively, the anti-FSTL1 antibody of the present invention or the fragment or functional equivalent thereof may be an antibody comprising an arbitrary sequence comprising a full-length CDR sequence, or an antigen binding fragment thereof, or an antibody comprising the variable region of a sequence related to a particular antibody of the present invention, or an antigen binding fragment thereof, wherein a framework region thereof contains the substitution, addition, or deletion of 1, 2, 3, 4, 5, 6, 7, 8, 9, 10, 12, 15, 17, or 20 or more amino acids. More specifically, as for such particular CDR, the antibody comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of antibody #5-2 (light chain: SEQ ID NO: 763; heavy chain: SEQ ID NO: 765), #5-3 (light chain: SEQ ID NO: 767; heavy chain: SEQ ID NO: 769), antibody #5-8 (light chain: SEQ ID NO: 771; heavy chain: SEQ ID NO: 773), #5-10 (light chain: SEQ ID NO: 775; heavy chain: SEQ ID NO: 777), #5-43 (light chain: SEQ ID NO: 779; heavy chain: SEQ ID NO: 781), #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #8-4 (light chain: SEQ ID NO: 795; heavy chain: SEQ ID NO: 797), #8-7 (light chain: SEQ ID NO: 799; heavy chain: SEQ ID NO: 801), #8-8 (light chain: SEQ ID NO: 803; heavy chain: SEQ ID NO: 805), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817), #22 (light chain: SEQ ID NO: 819; heavy chain: SEQ ID NO: 821) and #33 (light chain: SEQ ID NO: 823; heavy chain: SEQ ID NO: 825) or functional equivalents thereof (e.g., containing the conservative substitution of 1, 2, or 3 or more amino acids) as specific examples of heavy chain CDR1, CDR2, and CDR3 and light chain CDR1, CDR2, and CDR3. Alternatively, the anti-FSTL1 antibody of the present invention or the fragment or functional equivalent thereof may be a mutant of the antibody, wherein the mutant contains the substitution, addition, or deletion of 1 or several amino acids in a framework of the antibody but contains no mutation in the CDR. Embodiments described in another section herein and/or an approach known in the art can be used in the production of the antibody, etc. For the treatment or prevention of the present invention, it is preferred that such an antibody or a fragment or functional equivalent thereof should have suppressive activity against FSTL1 or a signaling pathway downstream therefrom. Such activity may be confirmed by examining the expression level of FSTL1 or its activity, or by directly using a cancer cell line and examining, for example, the inhibition of cell growth, the inhibition of metastatic activity, the inhibition of bone metastasis, the inhibition of the activity of enhancing immune defect such as immunosuppression or immunodeficiency by MSCs (e.g., growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity), the inhibition of imparting of immunosuppressive or immunodeficient properties to immune-related cells (e.g., growth of regulatory T cells, increase in the immunosuppressive activity of regulatory T cells, differentiation into regulatory T cells, growth of regulatory dendritic cells, increase in the immunosuppressive activity of regulatory dendritic cells, differentiation into regulatory dendritic cells, growth of tolerogenic dendritic cells, increase in the immunosuppressive activity of tolerogenic dendritic cells, differentiation into tolerogenic dendritic cells, growth of myeloid-derived suppressor cells, increase in the immunosuppressive activity of myeloid-derived suppressor cells, differentiation into myeloid-derived suppressor cells, growth of exhausted T cells, enhancement of the immunodeficient activity of exhausted T cells, and expansion of exhausted T cells caused by growth, induction, etc. of exhausted T cells, cytotoxic activity by antibody-dependent cellular cytotoxicity (ADCC), or observed retraction of tumor implanted in model animals. An approach therefor is well known in the art, and an approach used herein may be used. In a particular embodiment, such an antibody of the present invention can be an antibody selected from a monoclonal antibody, a polyclonal antibody, a chimeric antibody, a humanized antibody, a human antibody, a multifunctional antibody, a bispecific or oligospecific antibody, a single-chain antibody, scFv, diabody, sc(Fv)$_2$ (single chain (Fv)2), and scFv-Fc.

Herein, the amino acid sequences of CDRs of each antibody clone are underlined in the sequences of heavy and light chains.

5-2:

Light chain (L chain; SEQ ID NO: 763): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR</u>

<u>PSDI</u>PSRFSGSKSGSTATLTITGVQAEDEAVYFC<u>GGYDSSTGHGGI</u>FGAG

TTLTVL

Heavy chain (H chain; SEQ ID NO: 765): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G</u>

<u>VGKDGGTGYGAAVDGRATI</u>SKDNGQSTLRLQLNNLRAEDTGTYYCAK<u>AAG</u>

<u>GCSYGWCGSYVGDIDAW</u>GHGTEVIVSS

5-3

L chain (SEQ ID NO: 767): CDRs are underlined, and CDR1, CDR2, and CDR3 are shown in order from the N terminus.

ASTQPSSVSANPGETVKITC<u>SGGSGYYYG</u>WYQQKSPGSVPVTVIY<u>NNNNR</u>

<u>PSDI</u>PSRFSGSKSGSTGTLTITGVRAEDEAVYYC<u>GGYDNSGTGI</u>FGAGTT

LTVL

H chain (SEQ ID NO: 769): CDRs are underlined, and CDR1, CDR2, and CDR3 are shown in order from the N terminus.

AVTLDESGGGLQTPGGALSLVCKGSGFSFS<u>SFNMF</u>WVRQAPGKGLEWVA<u>G</u>

<u>IGKDGVPKYGAAVDGRATI</u>SKDNGQSTMRLQLNNLRAEDTGTYFCAK<u>AAG</u>

<u>GCSYDWCGIYAGDIDTW</u>GHGTEVIVSS

5-8

L chain (SEQ ID NO: 771): CDRs are underlined, and CDR1, CDR2, and CDR3 are shown in order from the N terminus.

ASTQPSSVSANPGEAVKITC<u>SGGSGSYYG</u>WYOQKSPGSAPVTVIY<u>NNNQR</u>

<u>PSDI</u>PSRFSGSKSGSTATLTITGVQAEDEAVYFC<u>GGYDSSTGHGGI</u>FGAG

TTLTVL

H chain (SEQ ID NO: 773): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>G</u>

<u>IGKDGVPKYGTAVDGRATI</u>SKDNGQSTMRLQLNNLRAEDTGTYFCAK<u>AAG</u>

<u>GCSYDWCGIYTGDIDTW</u>GHGTEVIVSS

5-10

L chain (SEQ ID NO: 775): CDRs are underlined, and CDR1, CDR2, and CDR3 are shown in order from the N terminus.

ASTQPSSVSANPGETVKITC<u>SGGGSYVGSYYYG</u>WYQQKSPGSAPVTVIY<u>NNNQRPS</u>DIPSRFSGSKSGSTATLTITGVQAEDEAVYFC<u>GGYDSSAGGI</u>FGAGTTLTVL

H chain (SEQ ID NO: 777): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVA<u>GVGKDGGTTYGAAVD</u>GRATISRDSGQSTVRLQLNDLRAEDTGTYFCAK<u>AAGGCSYSWCGAYVGDLDA</u>WGHGTEVTVSS

5-43
L chain (SEQ ID NO: 779): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQRPS</u>DIPSRFSGSKSGSTATLTITGVQAEDEAVYFC<u>GGYDSSTGHGGI</u>FGAGTTLTVL

H chain (SEQ ID NO: 781): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLEWVA<u>GIGKDGGTGYGAAVD</u>GRATISKDSGQSTLRLQLKNLRAEDTGTYYCAK<u>AAGGCSYDWCGAYTGDIDT</u>WGHGTEVIVSS

6-55
L chain (SEQ ID NO: 783): CDRs are underlined, and CDR1, CDR2, and CDR3 are shown in order from the N terminus.

ASTQPSSVSAIPGETVKITC<u>SGGGNNYG</u>WYQQRSPGSAPVTVIY<u>YNDNRPS</u>NIPSRFSGSTSGSTSTLTITGVQADDEAIYYC<u>GSWDSNTDSGI</u>FGAGTTLTVL

H chain (SEQ ID NO: 785): CDRs are underlined, and CDR1, CDR2, and CDR3 are shown in order from the N terminus.

AVTLDESGGGLGTPGGALSLVCKGSGFTFT<u>SVTMQ</u>WVRQAPGKGLSWVA<u>SVCSGSSTYYAPAVK</u>GRATISRDNGQSTVRLQLSNLRPEDTGTYYCAK<u>IAGRAHWSCTSAAYNIDA</u>WGHGTEVIVSS

7-34
L chain (SEQ ID NO: 787): CDRs are underlined, and CDR1, CDR2, and CDR3 are shown in order from the N terminus.

ASTQPSSVSANPGETVKITC<u>SGGGNNYG</u>WYQQKSPGSAPVTVIY<u>YNNNRPS</u>NIPSRFSGSTSGSTSTLTITGVQAEDEAVYYC<u>GSYEGSTDSGI</u>FGAGTTLTVL

H chain (SEQ ID NO: 789): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVA<u>SICSGSSTYYGPAVK</u>GRATISRDNGQNTVRLQLNNLRAEDTATYYCAK<u>IVGRGRWSCTSAAYNIDA</u>WGHGTEVIVSS

8-1
L chain (SEQ ID NO: 791): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQRPS</u>DIPSRFSGSKSGSTATLTITGVQAEDEAYYFC<u>GGYDSSSGHGGI</u>FGAGTTLTYL

H chain (SEQ ID NO: 793): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVA<u>GIGKPGVPKYGAAVD</u>GRATISKDNGQSTMRLQLNNLRAEDTGTYFCAK<u>AAGGCSYDWCGIYAGDIDT</u>WGHGTEVIVSS

8-4
L chain (SEQ ID NO: 795): CDRs are underlined, and CDR1, CDR2, and CDR3 are shown in order from the N terminus.

ASSQPSSVSANPGETVKITC<u>SGGSGYYYG</u>WYQQKSPGSAPVTVIY<u>NNDNKPS</u>DIPSRFSGSKSGSTGTLTITGVQVEDEAVYFC<u>GGYDNSGTGI</u>FGAGTTLTVL

H chain (SEQ ID NO: 797): CDRs are underlined, and CDR1, CDR2, and CDR3 are shown in order from the N terminus.

AVTLDESGGGLQTPGGGLSLVCKGSGFTLS<u>SFNMF</u>WVRQAPGKGLEWVA<u>GVGKDGGTAYGAAVD</u>GRATISRDSGQSTVRLQLNNLRAEDTGTYFCAK<u>AAGGCSYSWCGAYVGDLDA</u>WGHGTEVIVSS

8-7
L chain (SEQ ID NO: 799): CDRs are underlined, and CDR1, CDR2, and CDR3 are shown in order from the N terminus.

ASTQPSSVSANPGEAVKITC<u>SGGSGSYYG</u>WVQQKSPGSAPVTVIY<u>NNNQRPS</u>DIPSRFSGSKSGSTATLTITGVQAEDEAYYFC<u>GGYDSSTGHGGI</u>FGAGTTLTVL

H chain (SEQ ID NO: 801): CDRs are underlined, and CDR1, CDR2, and CDR3 are shown in order from the N terminus.

AVTLDESGGGLQTPGGGLSLVCKGSGFTFS<u>SFNMF</u>WVRQAPGKGLSWVA<u>G

IGKDGVPKYGAAVDG</u>RATISKDKGQSTLRLQLNNLRAEDTGTYFCAK<u>AAG

GCSYDWCGIYAGDIDT</u>WGHGTEVIVSS

8-8
L chain (SEQ ID NO: 803): CDRs are underlined, and CDR1, CDR2, and CDR3 are shown in order from the N terminus.

ASTQPSSVSANPGEAVKITC<u>SGGSGSYYG</u>WYQQKSPGSAPVTVIY<u>NNNQR

PS</u>DIPSRFSGSKSGSTATLTITGVQVEDEAVYFC<u>GGYDSSTGHGG</u>IFGAG

TTLTVL

H chain (SEQ ID NO: 805): CDRs are underlined, and CDR1, CDR2, and CDR3 are shown in order from the N terminus.

AVTLDESGGGLQTPGGALSLVCKGSGFTFS<u>SFNMF</u>WVRQAPGKGLEWVA<u>G

IGKDGVPKYGAAVDG</u>RATISKDNGQSTMRLQLNNLRAEDTGTYYCAK<u>AAG

GCSYGWCGAYTGDIDT</u>WGHGTEVIVSS

7
L chain (SEQ ID NO: 807): CDRs are underlined, and CDR1, CDR2, and CDR3 are shown in order from the N terminus.

ASTQPSSVSANPGETVKITC<u>SGGGSRYG</u>WYQQKSPGSAPVTVIY<u>YNDKRP

SN</u>IPSRFSGSKSGSTGTLTITGVRAEDEAVYFC<u>GGYDGSTDAAF</u>GAGTTL

TVL

H chain (SEQ ID NO: 809): CDRs are underlined, and CDR1, CDR2, and CDR3 are shown in order from the N terminus.

AVTLDESGGGLQTPGGALSLVCKASGFFFF<u>SIYDMG</u>WVRQA&GKGLEWVA

<u>GIDDYGE</u>YTGYGSAVKGRATISRDNGQSTVRLQLNNLRAEDTGTYYCAR<u>G

AGTGCNSAGCGAYAGSIDA</u>WGHGTEVIVSP

10
L chain (SEQ ID NO: 811): CDRs are underlined, and CDR1, CDR2, and CDR3 are shown in order from the N terminus.

ASTQPSSVSANPGETVKLTC<u>SGGGSRYG</u>WYQQKSPGSAPVTVIY<u>YNDKRP

SD</u>IPSRFSGSKSGSTATLTITGVQAEDEAVYFC<u>GGYDGSRDAGI</u>FGAGTT

LTVL

H chain (SEQ ID NO: 813): CDRs are underlined, and CDR1, CDR2, and CDR3 are shown in order from the N terminus.

AVTLDESGGGLQTPGGALSLVCKASGFFFF<u>RIYDMG</u>WVRQAPGKGLEWVA

<u>GIDDYGR</u>YTGYGSAVKGRATISRDNGQSTVRLQLNNLRAEDTGTYYCAR<u>G

AGTGCNSAGCGAYAGSIDA</u>WGHGTEVIVSS

13
L chain (SEQ ID NO: 815): CDRs are underlined, and CDR1, CDR2, and CDR3 are shown in order from the N terminus.

ASTQFSSVSANPGETVKITC<u>SGGGNNYG</u>WYQQKSPGSAPVTVIY<u>NNNNRP

SN</u>IPSRFSGSKSGSTNTLTITGVQAEDEAVYYC<u>GSYDSSSDSGI</u>FGAGTT

LTVL

H chain (SEQ ID NO: 817): CDRs are underlined, and CDR1, CDR2, and CDR3 are shown in order from the N terminus.

AVTLDESGGGLQTPGGGLSLVCKASGFTFS<u>SVTMQ</u>WVRQAPGKGLEWVA<u>S

ICSGSSTYYGPAVKG</u>RATISRDNGQNTVRLQLNNLRAEDTATYYCAK<u>IVG

RGRWSCTSAAYNIDA</u>WGHGTEVIVSS

22
L chain (SEQ ID NO: 819): CDRs are underlined, and CDR1, CDR2, and CDR3 are shown in order from the N terminus.

ASTQPSSVSANPGETVKITC<u>SGGSGSYGW</u>FQQKSPGSAPVTVIY<u>WDDRRP

SD</u>IPSRFSGSKSGSIHTLTITGVQADDEAVYLC<u>GNAVRSGTGYVGV</u>FGAG

TTLTVL

H chain (SEQ ID NO: 821): CDRs are underlined, and CDR1, CDR2, and CDR3 are shown in order from the N terminus.

AVTLDESGGGLQTPGGALSLVCKASGFTFS<u>SNGMA</u>WVRQAPGKGLELVA<u>R

INSSGSYTNYGAAVKG</u>RATISRDNGQSTVRLQLNNLRAEDTGTYYCAK<u>GA

SGYGAYPGNIDA</u>WGHGTEVIVSS

33
L chain (SEQ ID NO: 823): CDRs are underlined, and CDR1, CDR2, and CDR3 are shown in order from the N terminus.

ASTQPSSVSANPGETVEITC<u>SGDSSYYG</u>WFQQKSPGSAPVTVIY<u>DNTNRP

SD</u>IPSRFSGSKSGSTATLTITGVRAEDEAVYYC<u>GGYDSSTYDGI</u>FGAGTT

LTVL

H chain (SEQ ID NO: 825): CDRs are underlined, and CDR1, CDR2, and CDR3 are shown in order from the N terminus.

AVTLDESGGGLQTPGGGLSLVCKASGFTFS<u>SFNMN</u>WVRQAPGKGLEYVA<u>E

ISGTGSSTYYGSAVKG</u>RATISRDNGQSTVRLQLNNLRAEDTATYFCAR<u>GD

GAYSIDA</u>WGHGTEVIVSS

In a preferred embodiment, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or functional equivalents thereof (e.g., containing the conservative substitution of 1, 2, or 3 or more amino acids). In these clones, stronger binding activity against FSTL1 was observed in Examples. It is understood that a clone carrying similar CDRs is expected to maintain this stronger binding activity, and exerts similar drug efficacy.

Further preferably, the antibody for the anti-FSTL1 antibody of the present invention or the fragment or functional equivalent thereof comprises at least 1, preferably 2, 3, 4, or 5, more preferably all 6 of the heavy chain CDR1, heavy chain CDR2, heavy chain CDR3, light chain CDR1, light chain CDR2, and light chain CDR3 of an antibody selected from the group consisting of antibody #6-55 (light chain: SEQ ID NO: 783; heavy chain: SEQ ID NO: 785), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or functional equivalents thereof (e.g., containing the conservative substitution of 1, 2, or 3 or more amino acids). In these clones, stronger drug efficacy was observed in Examples. It is understood that a clone carrying similar CDRs is expected to maintain this stronger drug efficacy.

In an alternative embodiment, the antibody for the anti-FSTL1 antibody of the present invention or the fragment or functional equivalent thereof has particular full-length variable regions. Such particular variable regions include the full-length variable regions of antibody #5-2 (light chain: SEQ ID NO: 763; heavy chain: SEQ ID NO: 765), #5-3 (light chain: SEQ ID NO: 767; heavy chain: SEQ ID NO: 769), antibody #5-8 (light chain: SEQ ID NO: 771; heavy chain: SEQ ID NO: 773), #5-10 (light chain: SEQ ID NO: 775; heavy chain: SEQ ID NO: 777), #5-43 (light chain: SEQ ID NO: 779; heavy chain: SEQ ID NO: 781), #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #8-4 (light chain: SEQ ID NO: 795; heavy chain: SEQ ID NO: 797), #8-7 (light chain: SEQ ID NO: 799; heavy chain: SEQ ID NO: 801), #8-8 (light chain: SEQ ID NO: 803; heavy chain: SEQ ID NO: 805), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817), #22 (light chain: SEQ ID NO: 819; heavy chain: SEQ ID NO: 821) and #33 (light chain: SEQ ID NO: 823; heavy chain: SEQ ID NO: 825) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises the full-length variable regions of an antibody selected from the group consisting of #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or functional equivalents thereof (e.g., containing the conservative substitution of 1, 2, or 3 or more amino acids). In a preferred embodiment, the antibody for the anti-FSTL1 antibody of the present invention or the fragment or functional equivalent thereof comprises the full-length variable regions of an antibody selected from the group consisting of antibody #6-55 (light chain: SEQ ID NO: 783; heavy chain: SEQ ID NO: 785), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or functional equivalents thereof (e.g., containing the conservative substitution of 1, 2, or 3 or more amino acids).

In a preferred embodiment, the antibody for the anti-FSTL1 antibody of the present invention or the fragment or functional equivalent thereof comprises a full-length antibody selected from the group consisting of antibody #5-2 (light chain: SEQ ID NO: 853; heavy chain: SEQ ID NO: 855), #5-3 (light chain: SEQ ID NO: 857; heavy chain: SEQ ID NO: 859), antibody #5-8 (light chain: SEQ ID NO: 861; heavy chain: SEQ ID NO: 863), #5-10 (light chain: SEQ ID NO: 865; heavy chain: SEQ ID NO: 867), #5-43 (light chain: SEQ ID NO: 869; heavy chain: SEQ ID NO: 871), #6-55 (light chain: SEQ ID NO: 873; heavy chain: SEQ ID NO: 875), #7-34 (light chain: SEQ ID NO: 877; heavy chain: SEQ ID NO: 879), #8-1 (light chain: SEQ ID NO: 881; heavy chain: SEQ ID NO: 883), #8-4 (light chain: SEQ ID NO: 885; heavy chain: SEQ ID NO: 887), #8-7 (light chain: SEQ ID NO: 889; heavy chain: SEQ ID NO: 891), #8-8 (light chain: SEQ ID NO: 893; heavy chain: SEQ ID NO: 895), #7 (light chain: SEQ ID NO: 897; heavy chain: SEQ ID NO: 899), #10 (light chain: SEQ ID NO: 901; heavy chain: SEQ ID NO: 903), #13 (light chain: SEQ ID NO: 905; heavy chain: SEQ ID NO: 907), #22 (light chain: SEQ ID NO: 909; heavy chain: SEQ ID NO: 911) and #33 (light chain: SEQ ID NO: 913; heavy chain: SEQ ID NO: 915) or a humanized sequence thereof.

In a preferred embodiment, the antibody for the anti-FSTL1 antibody of the present invention or the fragment or functional equivalent thereof comprises a full-length antibody selected from the group consisting of antibody #6-55 (light chain: SEQ ID NO: 873; heavy chain: SEQ ID NO: 875), #7-34 (light chain: SEQ ID NO: 877; heavy chain: SEQ ID NO: 879), #8-1 (light chain: SEQ ID NO: 881; heavy chain: SEQ ID NO: 883), #7 (light chain: SEQ ID NO: 897; heavy chain: SEQ ID NO: 899), #10 (light chain: SEQ ID NO: 811; heavy chain: SEQ ID NO: 813), #13 (light chain: SEQ ID NO: 905; heavy chain: SEQ ID NO: 907) and #33 (light chain: SEQ ID NO: 913; heavy chain: SEQ ID NO: 915) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 783; heavy chain: SEQ ID NO: 785), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or a humanized sequence thereof.

In a preferred embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 926, 928, 930, and 932, respectively) and L chain FR1, FR2, FR3, and FR4 (SEQ ID NOs: 942, 944, 946, and 948, respectively) of H(2)-L(1).

In a preferred embodiment, the humanized antibody of the present invention has a heavy chain framework sequence comprising SEQ ID NOs: 918, 920, 922, and 924 (humanized heavy chain sequence FR1, FR2, FR3, and FR4 of H(1)), SEQ ID NOs: 926, 928, 930, and 932 (humanized heavy chain sequence FR1, FR2, FR3, and FR4 of H(2)), or SEQ ID NOs: 934, 936, 938, and 940 (humanized heavy chain sequence FR1, FR2, FR3, and FR4 of H(3)), and a light chain framework sequence comprising SEQ ID NOs: 942, 944, 946, and 948 (humanized light chain sequence FR1, FR2, FR3, and FR4 of L(1)), SEQ ID NOs: 988, 990, 992, and 994 (humanized light chain sequence FR1, FR2, FR3, and FR4 of L(2)), or SEQ ID NOs: 996, 998, 1000, and 1002 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 963, 965, 967, and 969, respectively) and light chain sequence FR1, FR2, FR3, and FR4 (SEQ ID NOs: 967, 968 or 971, 969 or 972, and 970, respectively) of corresponding chicken sequences, into amino acids in each of the chicken sequences. Preferably, the heavy chain framework sequence of H(2), i.e., SEQ ID NOs: 926, 928, 930, and 932 (humanized heavy chain sequence FR1, FR2, FR3, and FR4 of H(2)), or a sequence obtained by the mutation (back mutation) of one or more differing amino acids in the heavy chain framework sequence from heavy chain sequence FR1, FR2, FR3, and FR4 of a corresponding chicken sequence, into amino acids in the chicken sequence can be used. In the present specification, this is because use of H(2) was superior in activity by an order of magnitude in terms of $K_D$ value to H(1) and H(3). Also preferably, a light chain framework sequence comprising SEQ ID NOs: 942, 944, 946, and 948 (humanized light chain sequence FR1, FR2, FR3, and FR4, respectively, of L(1)) or a sequence obtained by the mutation (back mutation) of one or more differing amino acids in the light chain framework sequence from corresponding chicken light chain sequence FR1, FR2, FR3, and FR4 (SEQ ID NOs: 967, 968 or 971, 969 or 972, and 970, respectively) into amino acids in the chicken sequence can be used.

Further preferably, the humanized antibody has a heavy chain framework sequence comprising SEQ ID NOs: 918, 920, 922, and 924 (humanized heavy chain sequence FR1, FR2, FR3, and FR4 of H(1)), SEQ ID NOs: 926, 928, 930, and 932 (humanized heavy chain sequence FR1, FR2, FR3, and FR4 of H(2)), or SEQ ID NOs: 934, 936, 938, and 940 (humanized heavy chain sequence FR1, FR2, FR3, and FR4 of H(3)), or a sequence obtained by the mutation of 1 to 8 (e.g., 1, 2, 3, 4, 5, 6, 7, or 8) differing amino acids in the heavy chain framework sequence from corresponding chicken heavy chain sequence FR1, FR2, FR3, and FR4 (SEQ ID NOs: 963, 965, 967, and 969, respectively) into amino acids in the chicken sequence, and has a light chain framework sequence comprising SEQ ID NOs: 942, 944, 946, and 948 (humanized light chain sequence FR1, FR2, FR3, and FR4 of L(1)), SEQ ID NOs: 988, 990, 992, and 994 (humanized light chain sequence FR1, FR2, FR3, and FR4 of L(2)), or SEQ ID NOs: 996, 998, 1000, and 1002 (humanized light chain sequence FR1, FR2, FR3, and FR4 of L(3)), or a sequence obtained by the mutation of 1 to 4 (e.g., 1, 2, 3, or 4) differing amino acids in the light chain framework sequence from corresponding chicken light chain sequence FR1, FR2, FR3, and FR4 (SEQ ID NOs: 967, 968 or 971, 969 or 972, and 970, respectively) into amino acids in the chicken sequence.

In a preferred embodiment, at least 1, more preferably at least 2, at least 3, at least 4, or at least 5 differing amino acids that are taken into consideration for the back mutation of the humanized antibody are selected from Vernier residues. It is understood that the mutation may involve amino acid residues other than the Vernier residues as long as the activity is optimized. In a preferred embodiment, all of the differing amino acids are selected from Vernier residues. For the Vernier residue, see, for example, Japanese Patent Laid-Open No. 2010-4895 and Nishibori N et al., Molecular Immunology 43 (2006) 634-642, the description of which is incorporated herein by reference.

The Vernier residues include FR1 amino acid (SEQ ID NO: 926) positions 28 and 30, FR2 amino acid (SEQ ID NO: 928) position 12, and FR3 amino acid (SEQ ID NO: 930) positions 2, 10, 13, 17, and 32 of the H chain of the humanized sequence, and FR1 (SEQ ID NO: 942) position 20 and FR3 amino acid (SEQ ID NO: 946) positions 10, 15, and 31 of the L chain. It is understood that the Vernier sequences may vary among different sequences.

In one embodiment, the antibody of the present invention is a humanized antibody having any of the H chain FR1, FR2, FR3, and FR4 and L chain FR1, FR2, FR3, and FR4 of H(1)-L(1), H(2)-L(1), H(3)-L(1), H(1)-L(2), H(2)-L(2), H(3)-L(2), H(1)-L(3), H(2)-L(3), or H(3)-L(3). In another embodiment, the antibody of the present invention is a humanized antibody having the H chain FR1, FR2, FR3, and FR4 (SEQ ID NOs: 926, 928, 930, and 932, respectively) and L chain FR1, FR2, FR3, and FR4 (SEQ ID NOs: 942, 944, 946, and 948, respectively) of H(2)-L(1).

In an alternative embodiment, the antibody of the present invention is a humanized antibody having a heavy chain framework sequence comprising SEQ ID NOs: 918, 920, 922, and 924 (humanized heavy chain sequence FR1, FR2, FR3, and FR4 of H(1)), SEQ ID NOs: 926, 928, 930, and 932 (humanized heavy chain sequence FR1, FR2, FR3, and FR4 of H(2)), or SEQ ID NOs: 934, 936, 938, and 940 (humanized heavy chain sequence FR1, FR2, FR3, and FR4 of H(3)), or a mutant containing the substitution, addition, and/or deletion of 1 to 10 amino acids thereof, and a light chain framework sequence comprising SEQ ID NOs: 942, 944, 946, and 948 (humanized light chain sequence FR1, FR2, FR3, and FR4 of L(1)), SEQ ID NOs: 988, 990, 992, and 994 (humanized light chain sequence FR1, FR2, FR3, and FR4 of L(2)), or SEQ ID NOs: 996, 998, 1000, and 1002 (humanized light chain sequence FR1, FR2, FR3, and FR4 of L(3)), or a mutant containing the substitution, addition, and/or deletion of 1 to 10 amino acids thereof.

In a further alternative embodiment, the antibody of the present invention is a humanized antibody comprising a framework sequence consisting of a heavy chain framework sequence comprising SEQ ID NOs: 918, 920, 922, and 924 (humanized heavy chain sequence FR1, FR2, FR3, and FR4 of H(1)), SEQ ID NOs: 926, 928, 930, and 932 (humanized heavy chain sequence FR1, FR2, FR3, and FR4 of H(2)), or SEQ ID NOs: 934, 936, 938, and 940 (humanized heavy chain sequence FR1, FR2, FR3, and FR4 of H(3)), and a light chain framework sequence comprising SEQ ID NOs: 942, 944, 946, and 948 (humanized light chain sequence FR1, FR2, FR3, and FR4), SEQ ID NOs: 988, 990, 992, and 994 (humanized light chain sequence FR1, FR2, FR3, and FR4 of L(2)), or SEQ ID NOs: 996, 998, 1000, and 1002 (humanized light chain sequence FR1, FR2, FR3, and FR4 of L(3)), or a sequence containing the substitution, addition, and/or deletion of 1 to 10 amino acids, 1 to 9 amino acids, 1 to 8 amino acids, 1 to 7 amino acids, 1 to 6 amino acids, 1 to 5 amino acids, 1 to 4 amino acids, 1 to 3 amino acids, or 1 or 2 amino acids in the framework sequence.

A transformant can be prepared by transfecting a cell with a polynucleotide or vector encoding the antibody for the anti-FSTL1 antibody according to one embodiment of the present invention or the fragment or functional equivalent thereof. Use of this transformant permits preparation of the antibody for the anti-FSTL1 antibody according to the embodiments of the present invention or the fragment or functional equivalent thereof. The transformant may be a human or non-human mammalian (e.g., rat, mouse, guinea pig, rabbit, bovine, and monkey) cell. Examples of the mammalian cell include Chinese hamster ovary cells (CHO cells) and monkey cells COS-7. Alternatively, the transformant may be a bacterium of the genus *Escherichia*, a yeast, or the like.

For example, an *E. coli*-derived plasmid (e.g., pET-Blue), a *Bacillus subtilis*-derived plasmid (e.g., pUB110), a yeast-derived plasmid (e.g., pSH19), an expression plasmid for animal cells (e.g., pA1-11 and pcDNA3.1-V5/His-TOPO), a bacteriophage such as λ phage, or a virus-derived vector can be used as the vector described above. These vectors may contain a constituent necessary for protein expression, such as a promoter, a replication origin, or an antibiotic resistance gene. The vector may be an expression vector.

For example, a calcium phosphate method, lipofection, electroporation, an adenovirus-based method, a retrovirus-based method, or microinjection can be used as a method for transfecting the cell with the polynucleotide or vector described above (Shin Idenshi Kogaku Handobukku (New Gene Engineering Handbook in English), revised 4th edition, Yodosha Co., Ltd. (2003): 152-179). For example, a method described in "Tanpakushitsu Jikken Handobukku (Protein Experiment Handbook in English), Yodosha Co., Ltd. (2003): 128-142" can be used as a method for producing the antibody using cells. For example, ammonium sulfate, ethanol precipitation, protein A, protein G, gel filtration chromatography, anion- or cation-exchange chromatography, phosphocellulose chromatography, hydrophobic interaction chromatography, affinity chromatography, hydroxyapatite chromatography, or lectin chromatography can be used in the purification of the antibody (Tanpakushitsu Jikken Handobukku (Protein Experiment Handbook in English), Yodosha Co., Ltd. (2003): 27-52).

(Medicament and Anticancer Agent)

In one aspect, the present invention provides a medicament comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the medicament of the present invention.

In this aspect, the present invention provides the anti-FSTL1 antibody of the present invention or the fragment or functional equivalent thereof for use as a medicament. It is understood that an antibody of an arbitrary embodiment or arbitrary example described herein in the section (Anti-FSTL1 antibody), etc. can be used as the antibody or the fragment or functional equivalent thereof for use in the medicament of the present invention.

In this aspect, the present invention provides a method for treating or preventing a FSTL1-related disease, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides an anticancer agent comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof in the anticancer agent of the present invention.

In this aspect, the present invention provides the anti-FSTL1 antibody of the present invention or the fragment or functional equivalent thereof for the treatment or prevention of cancer. It is understood that an antibody of an arbitrary embodiment or arbitrary example described herein in the section (Anti-FSTL1 antibody), etc. can be used as the antibody or the fragment or functional equivalent thereof for the treatment or prevention of cancer of the present invention.

In this aspect, the present invention provides a method for treating or preventing cancer, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In an alternative aspect, the present invention provides a therapeutic or prophylactic agent for metastatic malignant tumor or metastasis of malignant tumor, comprising the anti-FSTL1 antibody of the present invention or the fragment or functional equivalent thereof. It is understood that an antibody of an arbitrary embodiment or arbitrary example described herein in the section (Anti-FSTL1 antibody), etc. can be used as the anti-FSTL1 antibody or the fragment or functional equivalent thereof for the metastatic malignant tumor of the present invention.

In this aspect, the present invention provides the anti-FSTL1 antibody of the present invention or the fragment or functional equivalent thereof for the treatment or prevention of metastatic malignant tumor or metastasis of malignant tumor. It is understood that an antibody of an arbitrary embodiment or arbitrary example described herein in the section (Anti-FSTL1 antibody), etc. can be used as the antibody or the fragment or functional equivalent thereof for use in the treatment of metastatic malignant tumor of the present invention.

In this aspect, the present invention provides a method for treating or preventing metastatic malignant tumor or metastasis of malignant tumor, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

The disease targeted by the present invention is cancer. Examples thereof can include, but are not limited to, melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, and metastatic malignant tumor thereof. The cancer may be a cancer type highly expressing SNAIL and/or FSTL1. As for the expression of SNAIL and/or FSTL1, information obtained in the human tumor tissue analysis information site of Oncomine (see Table 1A in FIG. 126) provided by oncomine.com/resource/login.html explains that high expression is found in melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma. Therefore, it is understood that effects similar to those demonstrated in Examples are also produced for these cancer types.

(Oncomine Data)

In an alternative aspect, the present invention provides an inhibitor of metastasis of cancer cells, comprising the anti-FSTL1 antibody of the present invention or the fragment or functional equivalent thereof, and provides an inhibitor capable of inhibiting even bone metastasis, lung metastasis, liver metastasis, spleen metastasis, lymph node metastasis, or brain metastasis, particularly, bone metastasis or lung metastasis.

In this aspect, the present invention provides the anti-FSTL1 antibody of the present invention or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells. It is understood that an antibody of an arbitrary embodiment or arbitrary example described herein in the section (Anti-FSTL1 antibody), etc. can be used as the antibody or the fragment or functional equivalent thereof for the inhibition of metastasis (e.g., bone metastasis, lung metastasis, liver metastasis, spleen metastasis, lymph node metastasis, or brain metastasis) of cancer cells, particularly, for the inhibition of bone metastasis or lung metastasis of cancer cells, according to the present invention.

In this aspect, the present invention provides a method for inhibiting metastasis (e.g., bone metastasis, lung metastasis, liver metastasis, spleen metastasis, lymph node metastasis, or brain metastasis) of cancer cells, particularly, for inhibiting bone metastasis or lung metastasis of cancer cells, comprising the step of administering an effective amount of the anti-FSTL1 antibody of the present invention or the fragment or functional equivalent thereof to a test subject in need thereof. Particularly, it has heretofore been considered that bone metastasis is very difficult to inhibit. Nonetheless, it has been found that this can be remarkably inhibited, as shown herein in Examples. In this respect as well, the superiority of the present invention is found. It is understood that an antibody of an arbitrary embodiment or arbitrary example described herein in the section (Anti-FSTL1 antibody), etc. can be used as the antibody or the fragment or functional equivalent thereof usable in the method of the present invention.

In a further alternative aspect, the present invention provides an inhibitor of induction or enhancement of immune defect such as immunosuppression or immunodeficiency by mesenchymal stem cells (MSCs), comprising the anti-FSTL1 antibody of the present invention or the fragment or functional equivalent thereof. The enhancement of immune defect such as immunosuppression or immunodeficiency includes at least one of growth of MSC cells having immunosuppressive activity or immunodeficient activity, enhancement of the immunosuppressive activity or immunodeficient activity of MSC cells having immunosuppressive activity or immunodeficient activity, and acquirement of immunosuppressive activity or immunodeficient activity by cells lacking immunosuppressive activity or immunodeficient activity. The enhancement of immune defect such as immunosuppression or immunodeficiency by mesenchymal stem cells (MSCs) also conceptually encompasses induction of mesenchymal stem cells inducing immune defect such as immunosuppression or immunodeficiency. Such MSCs having high immunosuppressive ability are also known as activated MSCs or cancer-associated MSCs. Although not wishing to be bound by any theory, FSTL1 secreted from Snail-positive cancer cells or the like acts on so-called progenitor cells of MSCs so that the MSCs secrete an agent causing differentiation of progenitor cells of immunosuppressive cells into immunosuppressive immune-related cells (e.g., regulatory T cells, regulatory dendritic cells, tolerogenic dendritic cells, and myeloid-derived suppressor cells) and/or an agent promoting growth thereof, and/or an agent enhancing their immunosuppressive activity. As a result, the so-called progenitor cells become immunosuppressive cells, probably leading to an immunosuppressed state. Accordingly, the action of the anti-FSTL1 antibody as described in the invention of the present application probably suppresses the action of FSTL1 and consequently mitigate an immunosuppressed state.

Thus, in an alternative aspect, the present invention provides an inhibitor of acquirement and/or enhancement of activity of immune defect such as immunosuppression or immunodeficiency by or of immune-related cells, comprising the anti-FSTL1 antibody of the present invention or the fragment or functional equivalent thereof. The acquirement and/or enhancement of activity of immune defect such as immunosuppression or immunodeficiency by or of immune-related cells also includes the event of induction of immunosuppressive cells. Therefore, the inhibitor of acquirement and/or enhancement of activity of immune defect such as immunosuppression or immunodeficiency by or of immune-related cells conceptually includes an inhibitor of induction of cells having the activity of immune defect such as immunosuppression or immunodeficiency. It is understood that an antibody of an arbitrary embodiment or arbitrary example described herein in the section (Anti-FSTL1 antibody), etc. can be used as the antibody or the fragment or functional equivalent thereof usable in the method of the present invention.

In this aspect, the present invention provides the anti-FSTL1 antibody of the present invention or the fragment or functional equivalent thereof for the inhibition of acquirement and/or enhancement of activity of immune defect such as immunosuppression or immunodeficiency by or of immune-related cells. It is understood that an antibody of an arbitrary embodiment or arbitrary example described herein in the section (Anti-FSTL1 antibody), etc. can be used as the antibody or the fragment or functional equivalent thereof for the inhibition of acquirement and/or enhancement of activity of immune defect such as immunosuppression or immunodeficiency by or of immune-related cells according to the present invention.

In this aspect, the present invention provides a method for inhibiting acquirement and/or enhancement of immunosuppressive activity, comprising the step of administering an effective amount of the anti-FSTL1 antibody of the present invention or the fragment or functional equivalent thereof to a test subject in need thereof. It is understood that an antibody of an arbitrary embodiment or arbitrary example described herein in the section (Anti-FSTL1 antibody), etc. can be used as the antibody or the fragment or functional equivalent thereof usable in the method of the present invention.

In one embodiment, the acquirement and/or enhancement of activity of immune defect such as immunosuppression or immunodeficiency for the inhibitor of the present invention includes at least 1, preferably at least 2, more preferably 3, more preferably 4, more preferably 5, more preferably 6, more preferably 7, more preferably 8, more preferably 9, more preferably 10, more preferably 11, more preferably all selected from the group consisting of growth of regulatory T cells, enhancement of the immunosuppressive activity of regulatory T cells, differentiation into regulatory T cells, enhancement of the immunosuppressive activity of regulatory dendritic cells, growth of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of (expansion of or differentiation into) exhausted T cells.

In a preferred embodiment, the present invention further includes a cell-killing agent in addition to the anti-FSTL1 antibody or the fragment or functional equivalent thereof and the chemotherapeutic agent. Thus, the composition, the agent, the medicament, etc. (therapeutic drug or prophylactic drug, etc.) of the present invention may comprise a complex molecule or may be conjugated therewith.

In one aspect, the combination drug of the present invention may be combined with additional cancer treatment, in addition to a FSTL1 suppressor and a chemotherapeutic agent. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In the present specification, "cell-killing agent" is an agent likely to lyse cell membranes. In the case of a peptide, the cell-killing agent is called cytotoxic peptide. The cytotoxic peptide has various names in the art and is also referred to as, for example, "lytic peptide component", "cell-killing sequence", "cytolytic peptide (sequence)", or "cell membrane lytic peptide (sequence)". These terms are used interchangeably for the purpose of the present invention. Typical examples of such a cytotoxic agent can include those listed in Gail D. et al., Cancer Res 2008; 68: 9280-9290; Ian Krop and Eric P. Winer, Clin Cancer Res; 20 (1); 1-6; and K Naito et al., Leukemia (2000) 14, 1436-144, and can include maytansinoid, emtansine, and N-acetyl-γ-calicheamicin dimethylhydrazide (NAc-γ-calicheamicin, DMH) contained in CMA-676, though the cytotoxic agent is not limited thereto. As for the peptide, typical examples of the cell-killing peptide can include, but are not limited to, cell membrane lytic peptides, cell membrane potential-destabilizing peptides, cell membrane lytic/nucleic acid-binding peptides, and mitochondrial membrane-disrupting peptides.

If necessary, such a cell-killing agent may be bound to the binding agent (antibody, etc.) of the present invention via a spacer. In the present specification, "spacer" refers to a moiety that forms a chemical bond between chain polymer molecules so as to bridge the molecules, and is also called linker. Typical examples of the peptide spacer include, but are not limited to, a sequence of 0 to 5 amino acids consisting of G or P. The spacer is not essential and may be absent.

In the present invention, the combination of the anti-FSTL1 antibody or fragment(s) or functional equivalent(s) thereof and chemotherapeutic agent(s), and the cell-killing agent may be provided as a complex molecule. For exemplary explanation of such a molecule, the molecule can be interpreted as being formed by a cytotoxic moiety which corresponds to an explosive moiety and a moiety in charge of specificity for cancer cells which corresponds to a warhead moiety (e.g., a peptide or a sequence, typically an antibody, specifically binding to a receptor highly expressed in cancer cells) in combination. In the case of using a spacer, the complex molecule is constituted by cancer cell-specific binding agent+spacer+ cell-killing agent. In the present specification, an arbitrary cancer cell-specific binding agent, an arbitrary spacer, and an arbitrary cell-killing agent can be arbitrarily combined, and exemplary production and use methods thereof are described. Such a molecule may be produced usually by a chemical synthesis method or, when constituted by peptides, by a method of forcedly expressing the molecule by gene recombination, followed by purification, or a combined method thereof.

As for the use of the present invention, the expression of FSTL1 on the surface of cancer cells to be treated and the damage sensitivity of the cancer cells for the cell-killing agent are examined. On the basis of the results, the warhead and the explosive are selected, and a molecule optimal for the cancer cells is designed. The treatment can be performed by combining a custom-made peptide toxin obtained by chemical synthesis or the like, if necessary, with DDS containing atelocollagen or the like, followed by local administration or systemic administration.

The present invention has been found from working effects on Snail-positive cancer cells. Therefore, although not wishing to be bound by any theory, the target of the present invention can include cancer caused by Snail-positive cancer cells. Since some cancer cells cause EMT and express SNAIL, cells with "EMT" reportedly express SNAIL not only in such limited and several types of cancers but in really various cancer types. Examples of such cancer can include, but are not limited to, squamous cell cancer, melanoma, colorectal cancer, breast cancer, lymphoma, lung cancer, prostate cancer, kidney cancer, thyroid gland cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma.

An administration route effective for treatment is preferably used for the therapeutic drug and may be, for example, intravenous, subcutaneous, intramuscular, intraperitoneal, or oral administration. The dosage form may be, for example, an injection, a capsule, a tablet, or granules. In the case of administering the antibody or the polynucleotide, use as an injection is effective. An injectable aqueous solution may be preserved in, for example, a vial or a stainless container. Also, the injectable aqueous solution may be supplemented with, for example, saline, sugar (e.g., trehalose), NaCl, or NaOH. The therapeutic drug may be supplemented with, for example, a buffer (e.g., a phosphate buffer solution), a stabilizer, or a sustained-release agent such as an adjuvant.

In general, the composition, the medicament, the agent (therapeutic agent, prophylactic agent, etc.), etc. of the present invention comprises a therapeutically effective amount of the therapeutic agent or active ingredient, and a pharmaceutically acceptable carrier or excipient. In the present specification, the phrase "pharmaceutically acceptable" means that for use in animals, more specifically, humans, the material has been approved by government's regulatory authorities or is pharmacopeial or is listed in other generally accepted pharmacopoeia. "Carrier" used herein refers to a diluent, an adjuvant, an excipient, or a vehicle that is administered together with the therapeutic agent. Such a carrier may be a sterile liquid, for example, water or oil. The carrier includes those of petroleum, animal, plant, or synthetic origin and includes, but is not limited to, peanut oil, soybean oil, mineral oil, and sesame oil. In the case of orally administering the medicament, water is a preferred carrier. In the case of intravenously administering the pharmaceutical composition, saline or aqueous dextrose is a preferred carrier. Preferably, a saline solution or an aqueous dextrose or glycerol solution is used as a liquid carrier for an injectable solution. An appropriate excipient includes light anhydrous silicic acid, crystalline cellulose, mannitol, starch, glucose, lactose, sucrose, gelatin, malt, rice, wheat flour, chalk, silica gel, sodium stearate, glycerol monostearate, talc, sodium chloride, powdered skim milk, glycerol, propylene, glycol, water, ethanol, carmellose calcium, carmellose sodium, hydroxypropylcellulose, hydroxypropylmethylcellulose, polyvinyl acetal diethylaminoacetate, polyvinylpyrrolidone, gelatin, medium-chain fatty acid triglyceride, polyoxyethylene hydrogenated castor oil 60, saccharose, carboxymethylcellulose, corn starch, inorganic salts, and the like. If desired, the composition may also contain a small amount of a wetting agent or emulsifying agent, or a pH buffering agent. Such a composition may assume the form of a solution, a suspension, an emulsion, a tablet, a pill, a capsule, a powder, a sustained-release formulation, or the like. The composition may be formulated as a suppository using a traditional binder and carrier, for example, triglyceride. An oral formulation may contain a standard carrier such as a pharmaceutical grade of mannitol, lactose, starch, magnesium stearate, saccharin sodium, cellulose, or magnesium carbonate. Examples of an appropriate carrier are described in E. W. Martin, Remington's Pharmaceutical Sciences (Mark Publishing Company, Easton, U.S.A). Such a composition contains a therapeutically effective amount of a therapeutic agent, preferably a purified form, together with an appropriate amount of the carrier, so as to provide a dosage form appropriate for a patient. The formulation must be suitable for the mode of administration. In addition, for example, a surfactant, an excipient, a colorant, a flavor, a preservative, a stabilizer, a buffer, a suspending agent, a tonicity agent, a binder, a disintegrant, a lubricant, a flowability-promoting agent, and a corrigent may be contained therein.

In the case of administering the medicament of the present invention, various delivery systems are known, and the therapeutic agent of the present invention may be administered to an appropriate site (e.g., the esophagus) using such a system. Such a system includes, for example: encapsulation in liposomes, microparticles, and microcapsules; use of recombinant cells capable of expressing the therapeutic agent (e.g., polypeptide); and use of endocytosis mediated by a receptor. An introduction method is not limited and includes, intracutaneous, intramuscular, intraperitoneal, intravenous, subcutaneous, intranasal, epidural, and oral routes. The medicament may be administered through any suitable route, for example, by injection, by bolus injection, or by absorption through epithelial or mucocutaneous linings (e.g., the mouth, the rectus, and intestinal mucosa). If necessary, an inhalator or an atomizer may be used by use of an aerosol agent. Furthermore, the medicament may be administered together with another biologically active agent. The administration may be systemic or local. The present invention also permits direct administration to tumor.

In a preferred embodiment, the composition can be formulated as a pharmaceutical composition adapted to administration to humans according to a publicly known method. Such a composition can be administered by injection. Typically, the composition for administration by injection is a solution in a sterile isotonic aqueous buffer. If necessary, the composition may also contain a solubilizing agent and a local anesthetic, such as lidocaine, which lessens pain at an injection site. In general, ingredients are separately supplied or mixed and supplied together in a unit dosage form, and can be supplied, for example, as a freeze-dried powder or a water-free concentrate in a sealed container, such as an ampule or a sachet, which indicates the amount of the active agent. In the case of administering the composition by injection, the composition may be dispensed using injection bottles containing a sterile drug grade of water or saline. In the case of administering the composition by injection, an ampule with sterile water or saline for injection may be provided such that ingredients can be mixed before the administration.

The antibody, etc. the composition, the medicament, the agent (therapeutic agent, prophylactic agent, etc.), etc. of the present invention may be formulated in a neutral or salt form or as any other prodrug (e.g., ester). A pharmaceutically acceptable salt includes a salt formed with a free carboxyl group derived from hydrochloric acid, phosphoric acid, acetic acid, oxalic acid, tartaric acid, or the like, a salt formed with a free amine group derived from isopropylamine, triethylamine, 2-ethylaminoethanol, histidine, procaine, or the like, and a salt derived from sodium, potassium, ammonium, calcium, ferric hydroxide, or the like.

The amount of the therapeutic agent of the present invention effective for the treatment of a particular disorder or condition may vary depending on the properties of the disorder or the condition and can be determined by those skilled in the art according to a standard clinical technique on the basis of the description of the present specification. In some cases, use of in vitro assay may assist in the identification of the optimum dosage range. An accurate dose to be used in a formulation may also vary depending on an administration route and the severity of a disease or a disorder and should therefore be determined according to the judgment of a doctor in attendance and the situation of each patient. However, the dose may be, but is not particularly limited to, for example, 0.001, 1, 5, 10, 15, 100, or 1000 mg/kg body weight in one dose, or may be within the range of any two of these values. The dosing interval may be, but is not particularly limited to, for example, once or twice per 1, 7, 14, 21, or 28 days, or may be once or twice per the range of any two of these values. The dose, the dosing interval, and the administration method may be appropriately selected according to the age and body weight of a patient, symptoms, a target organ, etc. The therapeutic drug preferably comprises the active ingredient in a therapeutically effective amount, or an effective amount that exerts the desired action. In the case where a malignant tumor marker is significantly reduced after administration, the therapeutic drug may be judged as having therapeutic effects. The effective dose is predictable from a dose-response curve obtained from an in vitro or animal model test system.

In one embodiment of the present invention, "patient" includes a human or a non-human mammal (e.g., one or more of a mouse, a guinea pig, a hamster, a rat, a rodent, a rabbit, a pig, sheep, a goat, cattle, a horse, a cat, a dog, a marmoset, a monkey, a chimpanzee, and the like). Also, the patient may be a patient judged or diagnosed as having FSTL1- or Snail-positive malignant tumor. In this respect, it is preferred to conduct the judgment or diagnosis by detecting the protein level of FSTL1 or Snail.

The pharmaceutical composition or the agent (therapeutic agent, prophylactic agent, etc.) of the present invention can be provided as a kit. In a particular embodiment, the present invention provides a drug pack or kit comprising one or more containers packed with one or more ingredients of the composition or the medicament of the present invention. In some cases, information indicating governmental agency's approval for production, use, or distribution for administration to humans in a form specified by the governmental agency that regulates the production, use, or distribution of medicaments or biological products may be shown with such containers.

The kit of the present invention may also contain an expression vector encoding a protein that is used as the antibody, etc., the composition, the therapeutic agent, the prophylactic agent, or the medicament of the present invention. This protein forms a biologically active complex after being expressed, and may therefore be reconstituted. Such a kit also preferably contains a necessary buffer and reagent. In some cases, an instruction manual (package insert) for use of the kit, and/or information indicating governmental agency's approval for production, use, or distribution for administration to humans in a form specified by the governmental agency that regulates the production, use, or distribution of medicaments or biological products may be shown with such containers.

The kit of the present invention may also contain an expression vector encoding a protein that is used as the antibody, etc., the composition, the therapeutic agent, the prophylactic agent, or the medicament of the present invention. This protein forms a biologically active complex after being expressed, and may therefore be reconstituted. Such a kit also preferably contains a necessary buffer and reagent. In some cases, an instruction manual (package insert) for use of the kit, and/or information, indicating governmental agency's approval for production, use, or distribution for administration to humans in a form specified by the governmental agency that regulates the production, use, or distribution of medicaments or biological products may be shown with such containers.

(Combination Drug)

In one aspect, the present invention provides a combination product of a FSTL1 suppressor and a chemotherapeutic agent. Although not wishing to be bound by any theory, the present invention is based on the unexpectedly remarkable enhancement of an effect on cancer as illustrated in Examples showing such a remarkable effect that lung cancer disappeared by suppressing the pathway of FSTL1 and also combining therewith cancer treatment using a chemotherapeutic agent, and the survival rate exceeded 60% within the examined range. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted as the suppressor, and any chemotherapeutic agent can be adopted as long as an anticancer effect is achieved by a similar mechanism. The FSTL1 suppressor and the chemotherapeutic agent that can be used in the present invention may be in any form including those listed above, etc. as long as the respective mechanisms of action as to the signaling pathway of FSTL1 and the chemotherapeutic agent are similar thereto. In a preferred embodiment, in the combination product of the present invention, the FSTL1 suppressor is an anti-FSTL1 antibody or a fragment or functional equivalent thereof, and/or the chemotherapeutic agent can be a derivative or the like having functions similar to those of cyclophosphamide or 5-fluorouracil.

In one aspect, the present invention provides a combination product of an anti-FSTL1 antibody or a fragment or functional equivalent thereof and a chemotherapeutic agent.

In one embodiment, the anti-FSTL1 antibody used in the present invention recognizes an epitope in a region selected from the group consisting of amino acid positions 48 to 100, 148 to 170 (preferably 148 to 162), 193 to 228 or 193 to 216, 205 to 228, and 272 to 289 of SEQ ID NO: 758 (amino acid sequence of human FSTL1).

In a preferred embodiment, the anti-FSTL1 antibody used in the present invention comprises the heavy chain CDR1, heavy chain CDR2, heavy chain CDR3, light chain CDR1, light chain CDR2, and light chain CDR3 of an antibody selected from the group consisting of antibody 6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825).

In a more preferred embodiment, the anti-FSTL1 antibody used in the present invention comprises the full-length variable regions of an antibody selected from the group consisting of antibody #6-55 (light chain: SEQ ID NO: 783; heavy chain: SEQ ID NO: 785), #7-34 (light chain: SEQ ID NO: 787; heavy chain: SEQ ID NO: 789), #8-1 (light chain: SEQ ID NO: 791; heavy chain: SEQ ID NO: 793), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825).

In a further alternative embodiment, the anti-FSTL1 antibody used in the present invention comprises a full-length antibody selected from the group consisting of antibody #6-55 (light chain: SEQ ID NO: 873; heavy chain: SEQ ID NO: 875), #7-34 (light chain: SEQ ID NO: 877; heavy chain: SEQ ID NO: 879), #8-1 (light chain: SEQ ID NO: 881; heavy chain: SEQ ID NO: 883), #7 (light chain: SEQ ID NO: 897; heavy chain: SEQ ID NO: 899), #10 (light chain: SEQ ID NO: 811; heavy chain: SEQ ID NO: 813), #13 (light chain: SEQ ID NO: 905; heavy chain: SEQ ID NO: 907) and #33 (light chain: SEQ ID NO: 913; heavy chain: SEQ ID NO: 915) or a humanized sequence thereof. Further preferably, the antibody for the anti-FSTL1 antibody of the present invention or the fragment or functional equivalent thereof comprises a full-length antibody selected from the group consisting of antibody #6-55 (light chain: SEQ ID NO: 783; heavy chain: SEQ ID NO: 785), #7 (light chain: SEQ ID NO: 807; heavy chain: SEQ ID NO: 809), #10 (light chain: SEQ ID NO: 811; heavy chain: SEQ ID NO: 813), #13 (light chain: SEQ ID NO: 815; heavy chain: SEQ ID NO: 817) and #33 (light chain: SEQ ID NO: 823; heavy chain: SEQ ID NO: 825) or a humanized sequence thereof.

In one embodiment, the antibody of the present invention is a humanized antibody, and the anti-FSTL1 antibody of the present invention or the fragment or functional equivalent thereof can be a humanized anti-FSTL1 antibody or a fragment or functional equivalent thereof. In a preferred embodiment, the humanized antibody of the present invention has the H chain FR1, FR2, FR3, and FR4 (SEQ ID NOs: 926, 928, 930, and 932, respectively) and L chain FR1, FR2, FR3, and FR4 (SEQ ID NOs: 942, 944, 946, and 948, respectively) of H(2)-L(1).

In one embodiment, the chemotherapeutic agent used in the present invention has a function of inhibiting DNA synthesis.

In a specific embodiment, the chemotherapeutic agent that can be used can be an alkylating agent, a nitrosourea agent, an antimetabolite, an anticancer antibiotic, a plant-derived alkaloid, a topoisomerase inhibitor, a hormone therapeutic agent, a hormone antagonist, an aromatase inhibitor, a P glycoprotein inhibitor, a platinum complex derivative, or a combination thereof.

In a preferred embodiment, the chemotherapeutic agent comprises an alkylating agent. In a specific embodiment, the chemotherapeutic agent that can be used comprises cyclophosphamide or a derivative thereof. Further preferably, the chemotherapeutic agent comprises cyclophosphamide.

In an alternative aspect, the present invention provides a medicament comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the medicament of the present invention. It is understood that an arbitrary embodiment or cyclophosphamide or a derivative thereof described herein can be used as the chemotherapeutic in the medicament of the present invention.

In a further alternative aspect, the present invention provides an anticancer agent comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention. It is understood that an arbitrary embodiment or cyclophosphamide or a derivative thereof described herein can be used as the chemotherapeutic agent in the medicament of the present invention.

In a further alternative aspect, the present invention provides a therapeutic agent for metastatic malignant tumor comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for metastatic malignant tumor of the present invention. It is understood that an arbitrary embodiment or cyclophosphamide or a derivative thereof described herein can be used as the chemotherapeutic agent in the medicament of the present invention.

In a further alternative aspect, the present invention provides a therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the therapeutic agent for these diseases of the present invention. It is understood that an arbitrary embodiment or cyclophosphamide or a derivative thereof described herein can be used as the chemotherapeutic agent in the medicament of the present invention.

In a further alternative aspect, the present invention provides an inhibitor of metastasis (e.g., bone metastasis or lung metastasis) of cancer cells, comprising the combination product of the present invention and provides an inhibitor capable of inhibiting even bone metastasis, lung metastasis, liver metastasis, spleen metastasis, lymph node metastasis, or brain metastasis, particularly, bone metastasis or lung metastasis. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of metastasis of cancer cells of the present invention. It is understood that an arbitrary embodiment or cyclophosphamide or a derivative thereof described herein can be used as the chemotherapeutic agent in the medicament of the present invention.

In a further alternative aspect, the present invention provides an inhibitor of induction or enhancement of immune defect such as immunosuppression or immunodeficiency by mesenchymal stem cells (MSCs), comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of induction or enhancement of immune defect such as immunosuppression or immunodeficiency by MSCs according to the present invention. It is understood that an arbitrary embodiment or cyclophosphamide, 5-fluorouracil or a derivative thereof described herein can be used as the chemotherapeutic agent in the medicament of the present invention.

In a further alternative aspect, the present invention provides an inhibitor of acquirement and/or enhancement of activity of immune defect such as immunosuppression or immunodeficiency by or of immune-related cells, comprising the combination product of the present invention. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the inhibitor of acquirement and/or enhancement of activity of immune defect such as immunosuppression or immunodeficiency by or of immune-related cells according to the present invention. It is understood that an arbitrary embodiment or cyclophosphamide, 5-fluorouracil or a derivative thereof described herein can be used as the chemotherapeutic agent in the medicament of the present invention.

In one embodiment, the acquirement and/or enhancement of immune defect activity by or of immune-related cells includes at least 1, preferably at least 2, more preferably at least 3, more preferably at least 4, more preferably at least 5, more preferably at least 6, more preferably at least 7, more preferably at least 8, more preferably at least 9, more preferably at least 10, more preferably at least 11, more preferably at least 12, more preferably at least 13, more preferably at least 14, more preferably all selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

In one aspect, the medicament, the anticancer agent, the therapeutic agent, or the inhibitor of the present invention may be combined with additional cancer treatment. Specifically, the additional cancer treatment includes an anticancer agent different from the anticancer agent of the present invention, surgical therapy, or radiation therapy, or a combination thereof.

Chemotherapy and radiation therapy for cancer inevitably cause an adverse reaction of drastically decreasing the growth of lymphocytes. In one embodiment, the administration of the composition of the present invention exhibits an effect of stimulating decreased lymphocyte cells to grow, and can also minimize a severe adverse reaction associated with usual chemotherapy. The same holds true for radiation therapy. The dose of a chemotherapeutic agent or the dose of radiation can be drastically decreased from a dose or irradiance usually used by combined use with the composition of the present invention. The composition for treatment of cancer of the present invention can be used or formulated in combination with an existing or novel chemotherapeutic agent different from the anticancer agent of the present invention. Examples of such a chemotherapeutic agent include alkylating agents, nitrosourea agents, antimetabolites, anticancer antibiotics, plant-derived alkaloids, topoisomerase inhibitors, hormone therapeutic agents, hormone antagonists, aromatase inhibitors, P glycoprotein inhibitors, platinum complex derivatives, and other immunotherapeutic agents or other anticancer agents. In order to restore the QOL of patients, the composition of the present invention can be used or formulated in combination with a therapeutic drug for leukopenia (neutropenia), a therapeutic drug for thrombocytopenia, an antiemetic, or a therapeutic drug for cancer pain, which is an auxiliary agent for cancer treatment.

In an alternative aspect, the present invention provides an anticancer agent comprising a FSTL1 suppressor, wherein the FSTL1 suppressor is administered in combination with a chemotherapeutic agent. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. It is understood that: the FSTL1 suppressor that can be used in the present invention may be in any form including those listed above, etc. as long as the suppressor can suppress the signaling pathway of FSTL1; the chemotherapeutic agent may be any chemotherapeutic agent as long as cancer can be eradicated by a similar mechanism of action; and in a preferred embodiment, in the anticancer agent of the present invention, the FSTL1 suppressor is an anti-FSTL1 antibody or a fragment or functional equivalent thereof, and an arbitrary embodiment described herein or cyclophosphamide or a derivative thereof can be used as the chemotherapeutic agent in the medicament of the present invention.

Preferably, the present invention provides an anticancer agent comprising an anti-FSTL1 antibody or a fragment or functional equivalent thereof, wherein the anti-FSTL1 antibody or the fragment or functional equivalent thereof is administered in combination with a chemotherapeutic agent. The type of usage of such an anticancer agent, which comprises the anti-FSTL1 antibody or the fragment or functional equivalent thereof, is combined use, and such combined use is described, for example, in a kit or in a package insert. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the anti-FSTL1 antibody or the fragment or functional equivalent thereof. It is understood that of an arbitrary embodiment or cyclophosphamide or a derivative thereof described herein can be used as the chemotherapeutic agent in the medicament of the present invention.

In an alternative aspect, the present invention provides an anticancer agent comprising a chemotherapeutic agent, wherein the chemotherapeutic agent is administered in combination with a FSTL suppressor. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be independently adopted as each of the suppressors. It is understood that: the FSTL1 suppressor that can be used in the present invention may be in any form including those listed above, etc. as long as the suppressor can suppress the signaling pathway of FSTL1; the chemotherapeutic agent may be any chemotherapeutic agent as long as cancer can be eradicated by a similar mechanism of action; and in a preferred embodiment, in the anticancer agent of the present invention, the FSTL1 suppressor is an anti-FSTL1 antibody or a fragment or functional equivalent thereof, and cyclophosphamide or a derivative thereof can be used as the chemotherapeutic agent.

Preferably, the present invention provides an anticancer agent comprising a chemotherapeutic agent or a fragment or functional equivalent thereof, wherein the chemotherapeutic agent is administered in combination with an anti-FSTL1 antibody or a fragment or functional equivalent thereof. It is understood that an antibody of an arbitrary embodiment described herein in the section (Anti-FSTL1 antibody), etc., or used in the medicament of the present invention, or of an arbitrary example described herein can be used as the anti-FSTL1 antibody or the fragment or functional equivalent thereof in the anticancer agent of the present invention comprising the chemotherapeutic agent. It is understood that an arbitrary embodiment or cyclophosphamide or a derivative thereof described herein can be used as the chemotherapeutic agent in the medicament of the present invention.

In one aspect, the present invention provides a method for treating or preventing cancer, comprising the step of administering an effective amount of a FSTL1 suppressor and an effective amount of a chemotherapeutic agent in combination. Although not wishing to be bound by any theory, the method of the present invention is based on the unexpectedly remarkable enhancement of an effect on cancer as illustrated in Examples showing such a remarkable effect that the majority of lung cancer patient survived by suppressing the pathway of FSTL1 and also using, in combination therewith, a mechanism underlying the eradication of cancer with a chemotherapeutic agent. From exemplary antibodies shown in Examples, it is understood that an arbitrary form selected from the group consisting of other suppressor and non-antibody forms, for example, an antigen binding fragment of the antibody, a derivative of the antibody or the fragment, a functional equivalent, an antisense nucleic acid, siRNA, an aptamer, and a ribozyme, and a complex thereof can be adopted. It is understood that: the FSTL1 suppressor that can be used in the present invention may be in any form including those listed above, etc. as long as the suppressor can suppress the signaling pathway of FSTL1; the chemotherapeutic agent may be any chemotherapeutic agent as long as cancer can be eradicated by a similar mechanism of action; and in a preferred embodiment, in the method of the present invention, the FSTL1 suppressor is an anti-FSTL1 antibody or a fragment or functional equivalent thereof, and an arbitrary embodiment described herein or cyclophosphamide or a derivative thereof can be used as the chemotherapeutic agent in the medicament of the present invention.

Preferably, the present invention provides a method for treating or preventing cancer, comprising the step of administering an effective amount of an anti-FSTL1 antibody or a fragment or functional equivalent thereof and an effective amount of a chemotherapeutic agent in combination to a test subject in need thereof. The anti-FSTL1 antibody or the fragment or functional equivalent thereof and the chemotherapeutic agent may be administered at the same time or may be administered separately (at different times). The anti-FSTL1 antibody or the fragment or functional equivalent thereof and the chemotherapeutic agent may be prepared as a combination formulation or may be administered as separate dosage forms. The anti-FSTL1 antibody or the fragment or functional equivalent thereof and the chemotherapeutic agent may be administered through the same route or may be administered through different routes (e.g., oral and intravenous routes).

(General Technique)

Molecular biological approaches, biochemical approaches, and microbial approaches used herein are well known in the art and conventionally used. These approaches are described in, for example, Sambrook J. et al. (1989). Molecular Cloning: A Laboratory Manual, Cold Spring Harbor and Id., 3rd Ed. (2001); Ausubel, F. M. (1987). Current Protocols in Molecular Biology, Greene Pub. Associates and Wiley-Interscience; Ausubel, F. M. (1989). Short Protocols in Molecular Biology: A Compendium of Methods from Current Protocols in Molecular Biology, Greene Pub. Associates and Wiley-Interscience; Innis, M. A. (1990). PCR Protocols: A Guide to Methods and Applications, Academic Press; Ausubel, F. M. (1992). Short Protocols in Molecular Biology: A Compendium of Methods from Current Protocols in Molecular Biology, Greene Pub. Associates; Ausubel, F. M. (1995). Short Protocols in Molecular Biology: A Compendium of Methods from Current Protocols in Molecular Biology, Wiley, and annual updates; Sninsky, J. J. et al. (1999). PCR Applications: Protocols for Functional Genomics, Academic Press, and Experimental Medicine, Suppl. "Experimental Methods for Gene Transfer & Expression Analysis", Yodosha Co., Ltd., 1997, the related parts (which may be the entire parts) of which are incorporated herein by reference.

DNA synthesis techniques and nucleic acid chemistry for preparing artificially synthesized genes are described in, for example, Gait, M. J. (1985). Oligonucleotide Synthesis: A Practical Approach, IRL Press; Gait, M. J. (1990). Oligonucleotide Synthesis: A Practical Approach, IRL Press; Eckstein, F. (1991). Oligonucleotides and Analogues: A Practical Approach, IRL Press; Adams, R. L. et al. (1992). The Biochemistry of the Nucleic Acids, Chapman & Hall; Shabarova, Z. et al. (1994). Advanced Organic Chemistry of Nucleic Acids, Weinheim; Blackburn, G. M. et al. (1996). Nucleic Acids in Chemistry and Biology, Oxford University Press; Hermanson, G. T. (1996). Bioconjugate Techniques, Academic Press, the related parts of which are incorporated herein by reference.

In the present specification, the oligonucleotide of the present invention may be synthesized, for example, by a standard method known in the art using, for example, an automatic DNA synthesis apparatus (e.g., commercially available from Biosearch Technologies, Inc., Applied Biosystems, Inc., etc.). For example, phosphorothioate oligonucleotide may be synthesized by the method of Stein et al. (Stein et al., 1988, Nucl. Acids Res. 16: 3209), and methylphosphonate oligonucleotide may be prepared by use of a controlled pore glass polymer support (Sarin et al., 1988, Proc. Natl. Acad. Sci. USA 85: 7448-7451) or the like.

In the present specification, the term "or" is used when "at least one or more" of the items listed in a sentence can be adopted. In the present specification, the phrase "within the range of two values" means that the range also includes the two values themselves.

References such as scientific literatures, patents, and patent applications cited herein are incorporated herein by reference in their entirety to the same extent as respectively described specifically.

The present invention is described above by showing preferred embodiments in order to facilitate understanding. Hereinafter, the present invention will be described with reference to Examples. However, the description mentioned above and Examples given below are provided merely for illustrative purposes and are not intended to limit the present invention. Thus, the scope of the present invention is limited by neither the embodiments nor Examples specifically described herein and is limited only by claims.

EXAMPLES

Hereinafter, the present invention will be further described with reference to Examples. However, the present invention is not intended to be limited by these examples.

<Example 1> Preparation of Anti-FSTL1 Antibody

Three 3-month-old Boris Brown chickens were intraperitoneally immunized with 100 µg of an antigen human FSTL1 (Novoprotein, Cat # CF23) (SEQ ID NO: 916) per shot per chicken. A complete Freund's adjuvant (Wako Pure Chemical Industries, Ltd., 014-09541) for primary immunization and an incomplete Freund's adjuvant (Wako Pure Chemical Industries, Ltd., 011-09551) for secondary, tertiary, and quaternary immunization were used in the intraperitoneal immunization with the antigen. For quinary immunization, the antigen diluted with PBS (phosphate buffered saline) was intravenously injected thereto. Blood was collected from the veins under the wings every other week, and antibody titers were confirmed by ELISA. The quaternary immunization was carried out for the three chickens, and one individual found to have the largest rise in antibody titer was subjected to quinary immunization, which was used as final immunization. Three days after final immunization, the spleen of the chicken was recovered, and lymphocytes were isolated by density gradient centrifugation using Ficoll paque PLUS (GE Healthcare Japan Corp., 17-1440-03), followed by RNA extraction using TRIzole Reagent (Life Technologies Corp., 15596026). cDNA was synthesized from the extracted RNA by RT-PCR using PrimeScript II 1st Strand cDNA Synthesis Kit (Takara Bio Inc., 6210A), and scFv phage libraries were prepared. The expression vector used was pPDS. The preparation of the scFv phage libraries was performed by the method described in the reference "Nakamura et al., J Vet Med Sci. 2004 Ju; 66 (7): 807-814".

FSTL1-specific phages were enriched by panning using the scFv phage libraries. The antigen used in the panning was human FSTL1 (Novoprotein, Cat # CF23) alone or two antigens for panning, human FSTL1 (R&D Systems, Inc., Cat #1694-FN-050) and mouse FSTL1 (R&D Systems, Inc., Cat #1738-FN-050), alternately used. Antibodies also having cross reactivity with mice were thereby obtained. The panning was performed according to the method described in the reference "Nakamura et al., J Vet Med Sci. 2004 Ju; 66 (7): 807-814". After the 5th round of panning, the reactivity of the libraries was confirmed by ELISA using human FSTL1- and mouse FSTL1-immobilized plates, and phage screening was conducted from a library whose reactivity started to rise. For scFv phage antibody sample preparation, E. coli was infected with a phage and plated over 2×YT Agar plate containing ampicillin (50 µg/ml, Nacalai Tesque, Inc., 02739-32), and the obtained colonies were cultured in a 2×YT liquid medium containing ampicillin. After infection with a helper phage, phage induction was performed in 2×YT liquid medium containing ampicillin (50 µg/ml), kanamycin (25 µg/ml, Meiji Seika Pharma Co., Ltd., GS1-RSS), and IPTG (100 µg/ml, Nacalai Tesque, Inc., 19742-94). The reactivity of scFv phage antibodies in the obtained culture supernatants was confirmed by ELISA using antigen-immobilized plates.

In screening by ELISA, 1 µg/ml of human FSTL1 or mouse FSTL1 diluted with PBS was placed at 50 µl/well to a 96-well plate (Nalge Nunc International, Cat. No. 442404), and the antigen was immobilized overnight at 4° C. After the immobilization, the wells were blocked with PBS containing 25% Block Ace (DS Pharma Biomedical Co., Ltd, UK-B80) and reacted with the culture supernatants containing the scFv phage antibodies. A solution of HRP-labeled Goat anti-mouse IgG (H+L) (Kirkegaard & Perry Laboratories, Inc. (KPL), Cat. No. 474-1806) diluted 1000-fold with 10% Block Ace was added as a secondary antibody, and the color development of OPD used as a substrate was measured as absorbance at 490 nm and 630 nm using a plate leader (Bio-Rad Laboratories, Inc., Model 680). These conditions are summarized in Table 1.

(Table 1 Screening Conditions)

TABLE 4-1

| | | | | |
|---|---|---|---|---|
| 1 | Immobilized antigen: | 50 µL/well | O/N, 4° C. | 1 µg/mL human or mouse FSTL1 |
| 2 | Blocking: | 250 µL/well | 60 min, 37° C. | 25% Block Ace/PBS |
| 3 | Primary antibody: | 50 µL/well | 60 min, 37° C. | scFv phage antibody-containing culture supernatant |
| 4 | Secondary antibody: | 50 µL/well | 60 min, 37° C. | HRP-anti-mouse IgG (H + L) in 10% Block Ace/PBS (1:1000) |
| 5 | Chromogenic substrate: | 50 µL/well | 30 min, RT | OPD solution |
| 6 | Reaction termination: | 50 µL/well | | 2N $H_2SO_4$ |
| 7 | Measurement: | Wavelength 490 nm/630 nm | | |

(O/N means overnight.)

The DNA sequencing of the positive clones obtained by ELISA was outsourced to Eurofins Genomics K. K. to determine the sequences.

As for clones differing in sequence, chicken-derived antibody H chain variable region and L chain variable region genes were amplified by PCR with a scFv antibody-encoding DNA strand as a template. Then, the PCR products were digested with restriction enzymes SacII (New England BioLabs Japan Inc., Cat # R0157S) and NheI (New England BioLabs Japan Inc., Cat # R0131S). Next, the H chain variable region and L chain variable region genes were respectively recombined into mouse/chicken chimeric antibody (IgG1) expression vectors (expression vector for H chain: pcDNA4/myc-His, expression vector for L chain: pcDNA3/myc-His, Invitrogen Corp.) treated with the same restriction enzymes as above. CHO cells were transfected with the prepared H chain and L chain constructs. Then, the reactivity of culture supernatants was confirmed by ELISA using a human or mouse FSTL1 protein-immobilized solid phase. The mouse chimeric expression vector used was the vector described in Tateishi et al., J Vet Med Sci. 2008 April; 70 (4): 397-400.

Among the antibody clones (chicken-mouse chimeric antibodies) thus obtained, clone #5-2, #5-3, #5-8, #5-10, #5-43, #6-55, #7-34, #8-1, #8-4, #8-7, #8-8, #6-55, #7, #10, #13, #22, and #33 were used in experiments given below. The amino acid sequences of the light chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 763, 767, 771, 775, 779, 783, 787, 791, 795, 799, 803, 807, 811, 815, 819, and 823, respectively. The full-length amino acid sequences of the light chains thereof are represented by SEQ ID NOs: 853, 857, 861, 865, 869, 873, 877, 881, 885, 889, 893, 897, 901, 905, 909, and 913, respectively. The nucleic acid sequences of the light chain variable regions thereof are represented by SEQ ID NOs: 762, 766, 770, 774, 778, 782, 786, 790, 794, 798, 802, 806, 810, 814, 818, and 822, respectively. The full-length nucleic acid sequences of the light chains thereof are represented by SEQ ID NOs: 852, 856, 860, 864, 868, 872, 876, 880, 884, 888, 892, 896, 900, 904, 908, and 912, respectively. The amino acid sequences of the heavy chain variable regions of clone #5-2, #5-3, #5-8, #5-10, #5-43, #6-55, #7-34, #8-1, #8-4, #8-7, #8-8, #6-55, #7, #10, #13, #22, and #33 are represented by SEQ ID NOs: 765, 769, 773, 777, 781, 785, 789, 793, 797, 801, 805, 809, 813, 817, 821, and 825, respectively. The full-length amino acid sequences of the heavy chains thereof are represented by SEQ ID NOs: 855, 859, 863, 867, 871, 875, 879, 883, 887, 891, 895, 899, 903, 907, 911, and 915, respectively. The nucleic acid sequences of the heavy chain variable regions thereof are represented by SEQ ID NOs: 764, 768, 772, 776, 780, 784, 788, 792, 796, 800, 804, 808, 812, 816, 820, and 824, respectively. The full-length nucleic acid sequences of the heavy chains thereof are represented by SEQ ID NOs: 854, 858, 862, 866, 870, 874, 878, 882, 886, 890, 894, 898, 902, 906, 910, and 914, respectively.

For the large-scale production of the antibody clones described above, cultured mammalian cells were transfected with the prepared H chain and L chain constructs using Expi293 Expression system (Invitrogen Corp., Cat # A14635). Then, the expressed antibodies were purified using Protein G Sepharose 4 Fast Flow (GE Healthcare Japan Corp., 17-018-02). The measurement of the binding activity of the obtained purified antibody of each clone against FSTL1 will be shown in Example 2.

<Example 2> Evaluation of Binding Activity of Purified Antibody Against FSTL1

The reactivity of the obtained antibody clones described above with FSTL1 was evaluated by ELISA under the following conditions.
(Table 2 ELISA conditions for binding activity evaluation of purified antibody)
Antibodies used: anti-dinitrophenyl (DNP) antibody (negative control), #5-2, #5-3, #5-8, #5-10, #5-43, #6-55, and #7-34

TABLE 4-2

| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |

TABLE 4-2-continued

| 3 Primary antibody: | 50 µL/well | 60 min, 37° C. | Each antibody serially diluted 2-fold from 1 µg/mL/10% Block Ace |
| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 nm | | |

O/N means overnight.

As a result, binding activity specific for human FSTL1 was confirmed. The strength of the binding activity was compared and was consequently #6-55, #7-34, and #5-10>#5-3>#5-8>#5-43 (FIG. 95A). Among the antibody clones, #6-55 and #7-34 exhibited specific and equivalently strong binding activity against both human and mouse FSTL1 (FIG. 95B).

FIGS. 96 and 97 show results of evaluating binding activity under the condition of Table 3 as to clones differing in screening and antibody purification timings.
(Table 3 ELISA conditions for binding activity evaluation of purified antibody)
Antibodies used: anti-DNP antibody, #5-8, #6-55, #7-34, #8-1, #8-4, #8-7, #8-8, #7, #10, #13, #22, and #33

TABLE 4-3

| 1 Immobilized antigen: | 50 µL/well | O/N, 4° C. | 5 µg/mL human or mouse FSTL1 |
| 2 Blocking: | 250 µL/well | 60 min, 37° C. | 25% Block Ace/PBS |
| 3 Primary antibody: | 50 µL/well | 60 min, 37° C. | Each antibody serially diluted 2-fold from 125 or 100 µg/mL/10% Block Ace |
| 4 Secondary antibody: | 50 µL/well | 60 min, 37° C. | HRP-anti-mouse IgG (H + L) in 10% Block Ace/PBS (1:1000) |
| 5 Chromogenic substrate: | 50 µL/well | 30 min, RT | OPD solution |
| 6 Reaction termination: | 50 µL/well | | 2N H$_2$SO$_4$ |
| 7 Measurement: | Wavelength 490 nm/630 nm | | |

O/N means overnight.

(Results)
Binding activity specific for human FSTL was confirmed. The strength of the binding activity was compared and was consequently #6-55 and #8-1>#8-7>#8-4>#8-8 (FIG. 96). As a result of further evaluating binding activity against human and mouse FSTL1, the strength of the binding activity against human FSTL1 was #6-55, #7-34, and #13>#8-1 and #10>#8-4>#7 and #33>#5-8>#22 (FIG. 97A). The strength of the binding activity against mouse FSTL1 was #6-55, #7-34, #10, and #13>#22>#7>#33>#8-1, and #8-1 very slightly exhibited binding activity (FIG. 97B). #5-8 and #8-4 exhibited no binding activity against mouse FSTL1.

<Example 3> Epitope Mapping of Antibody

In this Example, the antibodies obtained by preceding Examples were subjected to epitope mapping.
<Gene Synthesis>
For the synthesis of human and mouse FSTL1 genes, the sequences of His-tagged human and mouse FSTL1 genes were designed with reference to sequence information on NM_007085.4 (SEQ ID NO: 758) of the human FSTL1 gene and NM_008047.5 (SEQ ID NO: 760) of the mouse FSTL1 gene such that 3 alanine residues and 10 histidine residues were added to the C terminus. Further, codons were optimized in consideration of expression in mammalian cells. Genes in which nucleic acid sequences for plasmid insertion (SEQ ID NOs: 832 and 833) were respectively added to both ends of each gene were designed, and their synthesis was outsourced to Life Technologies Corp. The nucleic acid and amino acid sequences (SEQ ID NOs: 758, 759, 760, and 761) of the original human and mouse FSTL1 and the nucleic acid sequences of the actually synthesized genes and their amino acid sequences after translation (SEQ ID NOs: 826, 827, 828, and 829) are shown below. Sequence for insertion to plasmids: for N terminus:

(SEQ ID NO: 832)
5'-CGAACCCTTAAGCTTG-3'

(SEQ ID NO: 833)
5'-CGTGGCATCTAGACA-3 for C terminus:

(SEQ ID NO: 833)
5'-CGTGGCATCTAGACA-3 human FSTL1 nucleic acid sequence (SEQ ID NO: 758) <In the following sequences, a leader sequence is underlined>

<u>atgtggaaacgctggctgcgcgctcgcgctcgcgctggtggcggtcgcct
gggtccgcgcc</u>gaggaagagctaaggagcaaatccaagatctgtgccaat
gtgttttgtggagccggccgggaatgtgcagtcacagagaaggggaacc
cacctgtctctgcattgagcaatgcaaacctcacaagaggcctgtgtgtg
gcagtaatggcaagacctacctcaaccactgtgaactgcatcgagatgcc
tgcctcactggatccaaaatccaggttgattacgatggacactgcaaaga
gaagaaatccgtaagtccatctgccagcccagttgtttgctatcagtcca
accgtgatgagctccgacgtcgcatcatccagtggctggaagctgagatc
attccagatggctggttctctaaaggcagcaatacagtgaaatcctagac
aagtattttaagaactttgataatggtgattctcgcctggactccagtga
attcctgaagtttgtggaacagaatgaaactgccatcaatattacaacgt
atccagaccaggagaacaacaagttgcttagggactctgtgttgatgct
ctcattgaactgtctgatgaaaatgctgattggaaactcagcttccaaga
gtttctcaagtgcctcaacccatcttcaaccctcctgagaagaagtgtg
ccctggaggatgaaacgtatgcagatggagctgagaccgaggtggactgt
aaccgctgtgtctgtgcctgtggaaattgggtctgtacagccatgacctg
tgacggaaagaatcagaaggggcccagacccagacagaggaggagatga
ccagatatgtccaggagctccaaaagcatcaggaaacagctgaaaagacc
aagagagtgagcaccaaagagatctaa</u>

Mouse FSTL1 nucleic acid sequence (SEQ ID NO: 760)

<u>atgtggaaacgatggctggcgctctcgctggtgaccatcgccctggtcca
cggc</u>gaggaggaacctagaagcaaatccaagatctgcgccaatgtgttt gtggagctggcagggaatgtgccgtcacagagaaggggagcccacgtgc
ctctgcattgagcaatgcaaacctcacaagaggcctgtgtgtggcagtaa
tggcaagacctacctcaaccactgtgaacttcatagagatgcctgcctca
ctggatccaagatccaggttgattatgatgggcactgcaaagaaaagaag
tctgcgagtccatctgccagcccagttgtctgctatcaagctaaccgcga
tgagctccgacggcgcctcatccagtggctggaagctgagatcattccag
atggctggttctctaaaggcagtaactacagtgagatcctagacaagtac
tttaagagctttgataatggcgactctcacctggactccagtgaattcct
gaaattcgtggagcagaatgaaacagccatcaacatcaccacttatgcag
atcaggagaacaacaaactgctcagaagcctctgtgttgacgccctcatt
gaactgtctgatgagaacgctgactggaaactcagcttccaagagttcct
caagtgcctcaacccatccttcaaccctcctgagaagaagtgtgccctgg
aggacgaaacctatgcagatggagctgagactgaggtggactgcaatcgc
tgtgtctgttcctgtggccactgggtctgcacagcaatgacctgtgatgg
aaagaatcagaaggggggtccagacccacacagaggaggagaagacaggat
atgtccaggaactccagaagcaccagggcacagcagaaaagaccaagaag
gtgaacaccaaagagatctaa Nucleic acid sequence or human used in Examples (SEQ ID NO: 826)

<u>atgtggaagagatggctggccctggctctggcactggtggctgtggcttg
ggtgcgcgcc</u>gaggaagaactgcggagcaagagcaagatctgcgccaacg
tgttctgcggagccggcagagaatgtgccgtgaccgagaagggcgagcct
acctgcctgtgcatcgagcagtgcaagcccacaagaggcctgtgtgcgg
cagcaacggcaagacctacctgaaccactgcgagctgcaccgggatgcct
gtctgaccggcagcaagatccaggtggactacgacggccactgcaaagaa
aagaaaagcgtgtcccccagcgccagcccgtcgtgtgttaccagagcaa
cagggacgagctgcggcggagaatcatccagtggctggaagccgagatca
tccccgacggctggttcagcaagggcagcaactacagcgagatcctggac
aagtacttcaagaacttcgacaacggcgacagcagactggacagcagcga
gttcctgaagttcgtggaacagaacgagacagccatcaacatcaccacct
accccgaccaggaaaacaacaagctgctgcggggcctgtgcgtggacgcc
ctgattgagctgagcgacgagaacgccgactggaagctgagcttcagga
atttctgaagtgcctgaaccccagcttcaaccccccgagaagaagtgcg
ccctggaggacgagacatacgccgatggcgccgagacagaggtggactgc
aacagatgcgtgtgcgcctgcggcaactgggtgtgcaccgccatgacctg
cgacggcaagaatcagaagggcgcccagacccagaccgaagaagagatga
ccagatacgtgcaggaactgcagaagcaccaggaaaccgccgaaaagacc
aagcgggtgtccaccaaagagatcgccgctgcccaccaccatcaccatca
tcaccaccaccattga Nucleic acid sequence of mouse FSTL1 used in examples (SEQ ID NO: 828)

```
atgtggaagcggtggctggccctgagcctcgtgacaattgctctggtgca
cggcgaggaagaacccagaagcaagagcaagatctgcgccaacgtgttct
gcggagccggcagagaatgtgccgtgaccgagaagggcgagcctacctgc
ctgtgcatcgagcagtgcaagccccacaagaggcctgtgtgcggcagcaa
cggcaagacctacctgaaccactgcgagctgcaccgggatgcctgtctga
ccggcagcaagatccaggtggactacgacggccactgcaaagagaagaag
tccgccagccctagcgccagcccagtcgtgtgttaccaggccaaccggga
cgagctgcggcggagactgattcagtggctggaagccgagatcatccccg
acggctggttcagcaagggcagcaactacagcgagatcctggacaagtac
ttcaagagcttcgacaacggcgacagccacctggacagcagcgagttcct
gaagttcgtggaacagaacgagacagccatcaacatcaccacctacgccg
accaggaaaacaacaagctgctgagaagcctgtgcgtggacgccctgatc
gagctgagcgacgagaacgccgactggaagctgagctttcaggaatttct
gaagtgcctgaaccccagcttcaaccccccgagaagaaatgcgccctgg
aagatgagacatacgccgacggcgccgagacagaggtggactgcaataga
tgcgtgtgcagctgcggccactgggtgtgcaccgccatgacctgcgacgg
caagaaccagaaaggcgtgcagacccacaccgaggaagagaaaaccggct
acgtgcaggaactgcagaagcaccagggcaccgccgaaaagaccaagaaa
gtgaacaccaaagagatcgccgctgcccaccaccatcaccatcatcacca
ccaccattga
```

Human FSTL1 amino acid sequence (SEQ ID NO: 759)

MWKRWLALALALVAVAWVRAEEELRSKSKICANVFCGAGRECAVTEKGEP
TCLCIEQCKPHKRPVCGSNGKTYLNHCELHRDACLTGSKIQVDYDGHCKE
KKSVSPSASPVVCYQSNRDELRRRIIQWLEAEIIPDGWFSKGSNYSEILD
KYFKNFDNGDSRLDSSEFLFKVEQNETAINITTYPDQENNKLLRGLCVDA
LIELSDENADWKLSFQEFLKCLNPSFNPPEKKCALEDETYADGAETEVDC
NRCVCACGNWVCTAMTCDGKNQKGAQTQTEEEMTRYVQELQKHQETAEKT
KRVSTKEI

Mouse FSTL1 amino acid sequence (SEQ ID NO: 761)

MWKRWLALSLVTIALVHGEEEPRSKSKICANVFCGAGRECAVTEKGEPTC
LCIEQCKPHKRPVCGSNGKTYLNHCELHRDACLTGSKIQVDYDGHCKEKK
SASPSASPVVCYQANRDELRRRLIQWLEAEIIPDGWFSKGSNYSEILDKY
FKSFDNGDSHLDSSEFLKFVEQNETAINITTYADQENNKLLRSLCVDALI
ELSDENADWKLSFQEFTLKCLNPSFNPPEKKCALEDETYADGAETEVDCNR
CVCSCGHWVCTAMTCDGKNQKGVQTHTEEEKTGYVQELQKHQGTAEKTKK
VNTKEI

Amino acid sequence of human FSTL1 used in Examples (SEQ ID NO: 827)

MWKRWLALALALVAVAWVRAEEELRSKSKICANVFCGAGRECAVTEKGEP
TCLCIEQCKPHKRPVCGSNGKTYLNHCELHRDACLTGSKIQVDYGDHCKE
KKSVSPSASPVVCYQSNRDELRRRIIQWLEAEIIPDGWFSKGSNYSEILD
KYFKNFDNGDSRLDSSEFLFKVEQNETAINITTYPDQENNKLLRGLCVDA
LIELSDENADWKLSFQEFLKCLNPSFNPPEKKCALEDETYADGAETEVDC
NRCVCACGNWVCTAMTCDGKNQKGAQTQTEEEMTRYVQLEQKHQETAEKT
KRVSTKEIAAAHHHHHHHHH

Amino acid sequence of mouse FSTL1 used in Examples (SEQ ID NO: 828)

MWKRWLALSLVTIALVHGEEEPRSKSKICANVFCGAGRECACTEKGEPTC
LCIEQCKPHKRPVCGSNGKTYLNHCELHRDACLTGSKIQVDYDGHCKEKK
SASPSASPVVCYQANRDELRRRLIQWLEAEIIPDGWFSKGSNYSEILDKY
FKSFDNGDSHLDSSEFLKFVEQNETAINITTYADQENNKLLRSLCVDALI
ELSDENADWKLSFQEFTLKCLNPSFNPPEKKCALEDETYADGAETEVDCN
RCVCSCGHWVCTAMTCDGKNQKGVQTHTEEEKTGYVQELQKHQGTAEKTK
KVNTKEIAAAHHHHHHHHH

<Expression Vector Construction>

Next, the insertion of a multicloning site into pcDNA3.4TOPO® and a method for inserting the FSTL1 gene will be described.

The synthesis of sequences having a multicloning site given below was outsourced to FASMAC Corp. to synthesis single-stranded DNAs. Respective single-stranded DNAs are complementary to each other, and the synthesized single-stranded DNAs were prepared into a double strand and then inserted to pcDNA 3.4 TOPO® vector using pcDNA™3.4-TOPO® TA Cloning Kit (Life Technologies Corp., Cat # A14697).

Multicloning Site Sequence (SEQ ID NO: 830)
5'-AAGCTTGGATCCACTAGTGAATTCATCTACCAGCTAGCGTGGCATCT
AGACACTCTCGA GA-3'

(SEQ ID NO: 831)
5'CTCGAGAGTGTCTAGATGCCACGCTAGCTGGTAGATGAATTCACTAGT
GGATCCAAGCTT A-3'

E. coli was transformed with the plasmid obtained by the insertion of the multicloning site, and cultured, and plasmids were purified using PureYield™ Plasmid Midiprep System (Promega Corp., Cat # A2492). The purified plasmids were treated with restriction enzymes BamHI-HF (New England BioLabs Japan Inc. Cat # R3136L) and NheI-HF (New England BioLabs Japan Inc. Cat # R3131L) and subjected to 1% agarose electrophoresis. After the electrophoresis, the gels were stained with ethidium bromide, and the bands of the plasmids were excised. The plasmids were purified from the gels using NucleoSpin Gel and PCR Clean-up (Takara Bio Inc., Cat #740609.250).

The synthesized human FSTL1 (SEQ ID NO: 826) or mouse FSTL1 gene (SEQ ID NO: 828) was integrated into the plasmids treated with the restriction enzymes described above using GeneArt Seamless Cloning and Assembly Enzyme Mix (Invitrogen Corp., Cat # A14606), and E. coli was transformed with the resulting plasmids. The transformed E. coli was cultured. Plasmids were extracted and purified from the E. coli, and their DNA sequences were confirmed. Plasmids confirmed to have the intended human or mouse FSTL1 gene sequence as a result of the DNA sequencing were used as expression plasmids. The obtained human and mouse FSTL1 expression vectors were used in transient expression using Expi293™ Expression system (Life Technologies Corp., Cat # A14635). Culture supernatants after the expression were purified using HisPur Cobalt Resin (Thermo Fisher Scientific Inc., Cat #89964) and used as antigens for ELISA and epitope mapping ELISA.

<Preparation of FSTL1 Deletion Mutant>

Next, a method for preparing various deletion mutants will be shown. Expression vectors of deletion mutants were constructed using the human FSTL1 expression plasmid thus prepared as a template, primers for deletion mutant preparation, and KOD-Plus-Mutagenesis Kit (Toyobo Co., Ltd., Cat # SMK-101). The sites to be deleted were selected, except for sites rich in disulfide bond important for conformation, with reference to Uniprot No. Q12841 (see FIG. 98A) to prepare expression vectors of a deletion mutant containing deletion at amino acid positions 21 to 53 (Δ21-53), a deletion mutant containing deletion at amino acid positions 100 to 140 (Δ100-140), a deletion mutant containing deletion at amino acid positions 148 to 170 (Δ148-170), a deletion mutant containing deletion at amino acid positions 148 to 154 (Δ148-154), a deletion mutant containing deletion at amino acid positions 155 to 162 (Δ155-162), a deletion mutant containing deletion at amino acid positions 163 to 170 (Δ163-170), a deletion mutant containing deletion at amino acid positions 181 to 190 (Δ181-190), a deletion mutant containing deletion at amino acid positions 193 to 228 (Δ193-228), and a deletion mutant containing deletion at amino acid positions 233 to 289 (Δ233-289). These various deletion mutants were transiently expressed using Expi293™ Expression system. Culture supernatants after the expression were purified using HisPur Cobalt Resin and used as antigens for epitope mapping ELISA.

```
Δ21-53 (Forward primer)
                                (SEQ ID NO: 834)
5'-TGCATCGAGCAGTGCAAGCCCCACA-3'

Δ21-53 (Reverse primer)
                                (SEQ ID NO: 835)
5'-GGCGCGCACCCAAGCCACAGCCACC-3'

Δ100-140 (Forward primer)
                                (SEQ ID NO: 836)
5'-AAGGGCAGCAACTACAGCGAGATCC-3'

Δ100-140 (Reverse primer)
                                (SEQ ID NO: 837)
5'-TTTGCAGTGGCCGTCGTAGTCCACC-3'

Δ148-170 (Forward primer)
                                (SEQ ID NO: 838)
5'-TTCGTGGAACAGAACGAGACAGCCA-3'

Δ148-170 (Reverse primer)
                                (SEQ ID NO: 839)
5'-CTCGCTGTAGTTGCTGCCCTTGCTG-3'

Δ181-190 (Forward primer)
                                (SEQ ID NO: 840)
5'-AAGCTGCTGCGGGGCCTGTGCGTGG-3'

Δ181-190 (Reverse primer)
                                (SEQ ID NO: 841)
5'-GTTGATGGCTGTCTCGTTCTGTTCC-3'

Δ193-228 (Forward primer)
                                (SEQ ID NO: 842)
5'-CCCGAGAAGAAGTGCGCCCTGGAGG-3'

Δ193-228 (Reverse primer)
                                (SEQ ID NO: 843)
5'-CAGCTTGTTGTTTTCCTGGTCGGGG-3'

Δ233-289 (Forward primer)
                                (SEQ ID NO: 844)
5'-CTGCAGAAGCACCAGGAAACCGCCG-3'

Δ233-289 (Reverse primer)
                                (SEQ ID NO: 845)
5'-CTTCTTCTCGGGGGGGTTGAAGCTG-3'

Δ148-154 (Forward primer)
                                (SEQ ID NO: 846)
5'-AACTTCGACAACGGCGACAGCAGACT-3'

Δ148-154 (Reverse primer)
                                (SEQ ID NO: 847)
5'-CTCGCTGTAGTTGCTGCCCTTGCTG-3'

Δ155-162 (Forward primer)
                                (SEQ ID NO: 848)
5'-CTGGACAGCAGCGAGTTCCTGAAGT-3'

Δ155-162 (Reverse primer)
                                (SEQ ID NO: 849)
5'-CTTGAAGTACTTGTCCAGGATCTCG-3'

Δ163-170 (Forward primer)
                                (SEQ ID NO: 850)
5'-TTCGTGGAACAGAACGAGACAGCCA-3'

Δ163-170 (Reverse primer)
                                (SEQ ID NO: 851)
5'-TCTGCTGTCGCCGTTGTCGAAGTTC-3'

Δ193-204 (Forward primer)
                                (SEQ ID NO: 973)
5'-AGCGACGAGAACGCCGACTGG-3'

Δ193-204 (Reverse primer)
                                (SEQ ID NO: 974)
5'-CAGCTTGTTGTTTTCCTGGTCGGGG-3'

Δ205-216 (Forward primer)
                                (SEQ ID NO: 975)
5'-GAATTTCTGAAGTGCCTGAAC-3'

Δ205-216 (Reverse primer)
                                (SEQ ID NO: 976)
5'-CAGCTCAATCAGGGCGTCCAC-3'

Δ217-228 (Forward primer)
                                (SEQ ID NO: 977)
5'-CCCGAGAAGAAGTGCGCCCTGGAGG-3'

Δ217-228 (Reverse primer)
                                (SEQ ID NO: 978)
5'-CTGAAAGCTCAGCTTCCAGTC-3'

Δ233-251 (Forward primer)
                                (SEQ ID NO: 979)
5'-AGATGCGTGTGCGCCTGCGGC-3'

Δ233-251 (Reverse primer)
                                (SEQ ID NO: 980)
5'-CTTCTTCTCGGGGGGGTTGAAGCTG-3'

Δ252-270 (Forward primer)
                                (SEQ ID NO: 981)
5'-AATCAGAAGGGCGCCCAGACC-3'

Δ252-270 (Reverse primer)
                                (SEQ ID NO: 282)
5'-GTTGCAGTCCACCTCTGTCTCG-3'

Δ271-289 (Forward primer)
                                (SEQ ID NO: 983)
5'-CTTCTTCTCGGGGGGGTTGAAGCTG-3'
```

-continued

Δ271-289 (Reverse primer)
(SEQ ID NO: 984)
5'-CTTGCCGTCGCAGGTCATGGCG-3'

Δ48-100 (Forward primer)
(SEQ ID NO: 985)
5'-AAGAAAAGCGTGTCCCCCAGC-3'

Δ48-100 (Reverse primer)
(SEQ ID NO: 986)
5'-CTTCTCGGTCACGGCACATTC-3'

<Epitope Mapping ELISA>

Epitope mapping ELISA was conducted using the antigens thus prepared and antibodies given below. Antibodies used: various chicken-mouse chimeric antibodies obtained in Example 1, a rat anti-FSTL1 antibody (R&D Systems, Inc., Cat. No. MAB1694, clone 229007) evaluated in Examples of the patent literature WO2009/028411, an anti-DNP antibody as a negative control, and a rat IgG2b isotype control (R&D Systems, Inc., Cat. No. MAB0061, clone 141945)

(Table 4 Epitope mapping ELISA conditions)

TABLE 4-4

| 1 Immobilized antigen: | 50 μL/well | O/N, 4° C. | 5 μg/mL various human FSTL1 deletions mutants |
|---|---|---|---|
| 2 Blocking: | 250 μL/well | 60 min, 37° C. | 25% Block Ace/PBS |
| 3 Primary antibody: | 50 μL/well | 60 min, 37° C. | Each antibody 1 μg/mL/10% Block Ace |
| 4 Secondary antibody: | 50 μL/well | 60 min, 37° C. | HRP-anti-mouse IgG (H + L) or HRP-anti-Rat IgG (H + L) (Cell Signalling Technology, Inc., #7077S) in 10% Block Ace/PBS (1:1000) |
| 5 Chromogenic substrate: | 50 μL/well | 30 min, RT | OPD solution |
| 6 Reaction termination: | 50 μL/well | | 2N $H_2SO_4$ |
| 7 Measurement: | Wavelength 490 nm/630 nm | | |

The upper diagram of FIG. 98 shows a schematic diagram of human FSTL1 (with reference to Uniprot, No. Q12841) and the respective deletion sites of the prepared deletion mutants. As a result of the epitope mapping ELISA, the epitope site for each antibody is shown in the lower diagram of FIG. 98. As seen, #5-2, #5-3, #5-8, #5-10, #5-43, #8-1, #8-2, #8-4, and #8-7 were presumed to recognize a sequence contained in the amino acid sequence from positions 233 to 289 as an epitope, and #7, #10, and #22 were presumed to recognize a sequence contained in the amino acid sequence of positions 193 to 228 as an epitope. The epitope for the rat anti-FSLT1 antibody manufactured by R&D Systems, Inc. was predicted as a sequence contained in the amino acid sequence of positions 21 to 53 and thus found to be different from the epitopes for the various antibodies obtained in Example 1. #6-55, #7-34, and #13 were presumed to recognize a sequence contained in the amino acid sequence of positions 148 to 170 as an epitope. Further, these clones were judged as promising antibody clones by in vitro evaluation mentioned later. Therefore, the epitope sequence in the epitope-containing amino acid sequence of 148 to 170 was narrowed down. Specifically, a deletion mutant containing deletion at amino acid positions 148 to 154 (Δ148-154), a deletion mutant containing deletion at amino acid positions 155 to 162 (Δ155-162), and a deletion mutant containing deletion at amino acid positions 163 to 170 (Δ163-170) were prepared and subjected to epitope mapping ELISA in the same way as above. As a result, the epitope sites for #6-55, #7-34, and #13 are shown in the lower diagram of FIG. 98. As seen, these clones were presumed to recognize a sequence contained in the amino acid sequence of positions 148 to 162 as an epitope.

<Further Narrowing Down of Epitope>

The amino acid sequence of positions 148 to 170 (epitope for #6-55, #7-34, and #13), the amino acid sequence of positions 193 to 228 (epitope for #7, #10, and #22), and the amino acid sequence of positions 233 to 289 (epitope for #5-2, #5-3, #5-8, #5-10, #5-43, #8-1, #8-4, #8-7, and #8-8) were further fragmented as deletion sequences, and the epitope sequences were narrowed down. An epitope for clone #33 was identified.

The lower diagram of FIG. 98 reflects summary of these results. The putative epitope for #33 was present in the amino acid sequence of positions 48 to 100. The putative epitope for #7 and #10 was present in the amino acid sequence of positions 205 to 228. The putative epitope for #22 was present in the amino acid sequence of positions 193 to 216. The putative epitope for #5-2, #5-3, #5-10, #5-43, #8-1, #8-4, #8-7, and #8-10 was present in the amino acid sequence of positions 272 to 289.

Example 4: Evaluate of Inhibitory Activity Against Mesenchymal Stem Cell (MSC) Induction In this Example, inhibitory activity against the induction of mesenchymal stem cells (MSCs) by FSTL1 was evaluated.

It is known that when bone marrow cells are stimulated with FSTL1, mesenchymal stem cells (MSCs) having pluripotency or self-proliferative capacity grow (Cancer Research 73: 6185, 2013). Thus, $2 \times 10^7$ cells/well of bone marrow cells collected from the thigh bone of a C57BL/6 mouse were suspended in 3 mL/well of RPMI1640 (GIBCO/Thermo Fisher Scientific Inc., Cat. No. C11875500BT) medium containing 2% fetal bovine serum, supplemented with 50 ng/mL (final concentration) of FSTL1 (R&D Systems, Inc. Cat #1694-FN-050) and 10 μg/mL of the anti-FSTL1 antibody (#5-2, #5-3, #5-8, #5-10, #5-43, #6-55, or #7-34) or its isotype mouse IgG (anti-DNP antibody) as a control antibody "Control", and cultured under stimulation (6-well plate). 11 days thereafter, the number of cells was counted while the cells were stained with a PE-labeled anti-ALCAM antibody (eBioscience, Cat. No. 12-1661-82) and a PE-labeled anti-PDGFRA antibody (eBioscience, Cat #12-1401-81) in order to examine the expression of MSC markers, and the contents of ALCAM-positive cells and PDGFR-positive cells were analyzed by flow cytometry using FACScan (Becton, Dickinson and Company, Code. BECTON-DICKINSON-FACSCAN) to calculate the number of each positive cell per culture. As a result, all of the antibody clones exhibited inhibitory activity against the expansion of ALCAM-positive cells and PDGFRA-positive cells by FSTL1, as compared with the control antibody (anti-DNP antibody). Among them, #5-43, #6-55, and #7-34 exhibited slightly strong tendency of inhibitory activity.

Example 5: Evaluation of Inhibitory Activity Against Activation of Tumor Cell by FSTL1

In this Example, inhibitory activity against the activation of tumor cells by FSTL1 was evaluated.

It is known that tumor cells activated by stimulation with FSTL1 highly express molecule groups promoting bone metastasis and increase metastatic invasive capacity (Cancer Research 73: 6185, 2013). Thus, $2 \times 10^7$ cells/well of a human pancreatic cancer cell line Pancl were suspended in 1 mL/well of D-MEM medium (GIBCO/Thermo Fisher Scientific Inc. Cat. No. C11885500BT) containing 10% fetal bovine serum, supplemented with 50 ng/mL (final concentration) of FSTL1 (R&D Systems, Inc.) and 10 µg/mL of the anti-FSTL1 antibody (#5-2, #5-8, #5-10, #5-43, #6-55, or #7-34) or its isotype mouse IgG (anti-DNP antibody) as a control antibody "Control", and cultured under stimulation (6-well plate). 3 days thereafter, the number of cells was counted while the cells were stained with a PE-labeled anti-RANKL antibody (eBioscience Cat. No. 12-6619) and a PE-labeled anti-CCR2 antibody (R&D Systems, Inc. Cat. No. FAB151P) in order to examine the expression of markers indicating bone metastatic properties, and the contents of RANKL-positive cells and CCR2-positive cells were analyzed by flow cytometry using FACScan (Becton, Dickinson and Company) to calculate the numbers of cells per culture. As a result, all of the antibody clones exhibited inhibitory activity against the expansion of RANKL-positive cells by FSTL1, as compared with the control antibody (anti-DNP antibody). The results of this experiment revealed that when the content of RANKL-positive cells and the number of cells per culture were compared, the number of cells was confirmed to be more appropriate for evaluation. Therefore, in Examples below, judgment was made with the number of cells as an index.

Example 6: Evaluation of Inhibitory Activity Against Induction of Mesenchymal Stem Cell (MSC) by FSTL1

In this Example, the same experiment as in Example 4 was conducted.

Mouse bone marrow cells prepared in the same way as in Example 4 were supplemented with 50 ng/mL (final concentration) of FSTL1 and 10 µg/mL of the anti-FSTL1 antibody (#5-2, #5-3, #5-8, #5-10, #5-43, #6-55, or #7-34) or a control antibody anti-DNP antibody and cultured under stimulation. 11 days thereafter, the number of cells was counted while the cells were stained with a PE-Cy5-labeled anti-CD45 antibody (BD Pharmingen/Becton, Dickinson and Company, Cat. No. 555484), and the content of CD45-negative cells reported to generally contain MSCs at a high rate was analyzed by flow cytometry using FACScan to calculate the percentage and number of MSCs per culture (FIG. 99A). As a result, all of the antibody clones exhibited inhibitory activity against the expansion of CD45-negative cells by FSTL1, as compared with the control antibody. Among them, #5-3, #5-8, #7-34, and #5-43 exhibited higher inhibitory activity and substantially completely inhibited the action of FSTL1.

Example 7: Evaluation of Inhibitory Activity Against Activation of Tumor Cell by FSTL1

In this Example, inhibitory activity against the activation of tumor cells by FSTL1 was evaluated in RANKL-positive cells and CCR2-positive cells.

In the same way as in Example 5, a human pancreatic cancer cell line Pancl was supplemented with 50 ng/mL (final concentration) of FSTL1 (R&D Systems, Inc.) and 10 µg/mL of the anti-FSTL1 antibody (the same clones as in Example 6) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 99B). As a result, all of the antibody clones exhibited inhibitory activity against the expansion of RANKL-positive cells and CCR2-positive cells, as compared with the control antibody. Among them, #5-3 and #5-8 exhibited higher inhibitory activity.

Example 8: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated in the same way as in Examples 4 and 6 except that the concentration was changed.

Mouse bone marrow cells prepared in the same way as in Example 4 were supplemented with 20 ng/mL (final concentration) of FSTL1 and 10 µg/mL of the anti-FSTL1 antibody (#5-2, #5-3, #5-8, #5-10, #5-43, #6-55, #8-1, #8-4, #8-7, and #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 100A). As a result, #5-8, #5-43, #6-55, #8-1, and #8-4 exhibited inhibitory activity against the expansion of CD45-negative cells by FSTL1, as compared with the control antibody.

Example 9: Evaluation of Inhibitory Activity Against Activation of Tumor Cell by FSTL1

In this Example, inhibitory activity against the activation of tumor cells by FSTL1 was evaluated at lower concentration.

In the same way as in Example 5, a human pancreatic cancer cell line Pancl was supplemented with 20 ng/mL (final concentration) of FSTL1 and 10 µg/mL of the anti-FSTL1 antibody (#5-2, #5-8, or #6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture (FIG. 100B). As a result, #5-8 and #6-55 also exhibited inhibitory activity against the expansion of RANKL-positive cells and CCR2-positive cells using the concentration of 20 ng/mL (final concentration), as compared with the control antibody.

Example 10: Evaluation of Inhibitory Activity Against Activation of Tumor Cell by FSTL1

In this Example, inhibitory activity against the activation of tumor cells by FSTL1 was evaluated, also including newly obtained clones.

In the same way as in Example 5, a human pancreatic cancer cell line Pancl was supplemented with 50 ng/mL (final concentration) of FSTL1 and 10 µg/mL of the anti-FSTL1 antibody (#5-2, #5-3, #6-55, #7-34, #8-1, #8-4, #8-7, or #8-8) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, #5-2, #6-55, #8-4, and #8-7 exhibited high inhibitory activity against the expansion of RANKL-positive cells and CCR2-positive cells, as compared with the control antibody (FIG. 100C).

Example 11: Evaluation of Inhibitory Activity Against Activation of Tumor Cell by FSTL1 (Dose Dependence Test)

In this Example, inhibitory activity against the activation of tumor cells by FSTL1 was evaluated at varying doses including a low dose.

In the same way as in Example 5, a human pancreatic cancer cell line Panc1 was supplemented with 50 ng/mL (final concentration) of FSTL1 and 10 µg/mL of the anti-FSTL1 antibody (#6-55) or a control antibody and cultured under stimulation. 3 days thereafter, the number of cells was counted while the cells were stained with a PE-labeled anti-RANKL antibody and a PE-labeled anti-CCR2 antibody, and the contents of RANKL-positive cells and CCR2-positive cells were analyzed by flow cytometry using FACScan (Becton, Dickinson and Company) to calculate the numbers of cells per culture. As a result, the tested #6-55 exhibited substantially 100% inhibitory activity against the expansion of RANKL-positive cells and CCR2-positive cells at all of the tested doses (5 µg/mL, 10 µg/mL, and 20 µg/mL), as compared with the control antibody, though the dose dependence of antibody was not confirmed (FIG. 100D).

Example 12: Evaluation of Inhibitory Activity Against Induction of Mesenchymal Stem Cell (MSC) by FSTL1

In this Example, inhibitory activity against the induction of mesenchymal stem cells (MSCs) by FSTL1 was evaluated, including further clones.

Mouse bone marrow cells prepared in the same way as in Example 4 were supplemented with 20 ng/mL (final concentration) of FSTL1 and 10 µg/mL of the anti-FSTL1 antibody (#5-2, #5-8, #6-55, #7-34, #8-1, #8-4, #8-7, or #8-8) or a control antibody anti-DNP antibody and cultured under stimulation. 8 days thereafter, the number of cells was counted while the cells were stained with a PE-Cy5-labeled anti-CD45 antibody, and the content of CD45-negative cells was analyzed by flow cytometry using FACScan to calculate the percentage and number of MSCs per culture (FIG. 101). As a result, all of the clones exhibited inhibitory activity against the expansion of CD45-negative cells by FSTL1, as compared with the control. Particularly, higher inhibitory activity was confirmed in the order of #7-34, #5-2, #6-55, and #8-7.

<Example 13: Evaluation of Inhibitory Activity Against Induction of Mesenchymal Stem Cell (MSC), Cancer-Associated MSC, and Myeloid-Derived Suppressor Cell (MDSC) by FSTL1>

In this Example, inhibitory activity against the induction of mesenchymal stem cells (MSC), cancer-associated MSCs, and myeloid-derived suppressor cells (MDSCs) by FSTL1 was evaluated.

Mouse bone marrow cells prepared in the same way as in Example 4 were supplemented with 20 ng/mL (final concentration) of FSTL1 and 10 µg/mL of the anti-FSTL1 antibody (#6-55, #7-34, #8-1, or #8-4), an anti-PD-L1 antibody reported to have an immunosuppression-mitigating effect, or a control antibody anti-DNP antibody and cultured under stimulation. 8 days thereafter, the number of cells was counted while the cells were stained with a PE-Cy5-labeled anti-CD45 antibody, a PE-labeled anti-ALCAM antibody, a FITC-labeled anti-CD271 antibody (Abcam plc, Cat. No. AB62122), a FITC-labeled anti-CD11b antibody (BD Pharmingen/Becton, Dickinson and Company, Cat. No. 553310), and a PE-Cy5-labeled anti-Gr1 antibody (eBioscience, Cat. No. 15-5931) in order to detect MSCs (CD45-negative cells), cancer-associated MSCs (CD45-negative, ALCAM-positive, and CD271-positive cells) which are MSCs increasing in number in association with cancer metastasis, and monocytic myeloid-derived suppressor cells (M-MDSCs: CD11b-positive, Gr1-positive, and ALCAM-positive cells) increasing in number together with cancer-associated MSCs, and the contents of the cells mentioned above were analyzed by flow cytometry using FACScan to calculate the percentage and number of MSCs per culture (FIG. 102). As a result, all of the clones exhibited high inhibitory activity against the induction of MSCs, cancer-associated MSCs, and M-MDSCs by FSTL1, as compared with the control antibody. PD-L1 is expressed in MSC and presumably influences the induction of MSCs. However, inhibitory activity was found to be stronger in the anti-FSTL1 antibodies.

Example 14: Evaluation of Inhibitory Activity Against Induction of Mesenchymal Stem Cell (MSC), Cancer-Associated MSC, and Myeloid-Derived Suppressor Cell (MDSC) by FSTL1, and Evaluation of Ability to Differentiate into Adipocyte)

In this Example, inhibitory activity against the induction of mesenchymal stem cells (MSCs), cancer-associated MSCs, and myeloid-derived suppressor cells (MDSCs) by FSTL1 was evaluated.

The antibody clone (#6-55, #7, #10, #13, or #22) was evaluated for its activity by the same testing method as in Example 13. #6-55 was set as a positive control for activity. As a result, all of the clones exhibited inhibitory activity against the induction of MSCs, cancer-associated MSCs, and M-MDSCs by FSTL1, as compared with the control antibody. Among them, #13 exhibited inhibitory activity equivalent to or higher than that of the positive control (FIG. 103A). These results seem to be reasonable because epitopes for #13 and #6-55 are the same regions. FIG. 103B shows results of analyzing inhibitory activity against the induction of MSCs having the ability to differentiate into adipocytes. Mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation. In the graph, none is depicted in the leftmost bar, and the control antibody is depicted in the second bar from the left followed by the anti-FSLT1 antibody clones. Adipocytes were not confirmed for any of the anti-FSLT1 antibodies. It is understood that the differentiation induction of MSCs serving as the original source is inhibited.

Example 15: Comparison with Conventional Antibody

In this Example, activity was compared with an anti-FSTL1 antibody (manufactured by R&D Systems, Inc.) evaluated in Examples of Patent Literature 1 (WO2009/028411).

FSTL1 inhibitory activity was compared between the rat anti-FSTL1 antibody of R&D Systems, Inc. (Cat. No. MAB1694, clone 229007) found in Patent Literature 1 (WO2009/028411) to exhibit inhibitory activity against the induction of regulatory T cells important for immunosuppression, and #6-55 of the present invention.

Mouse bone marrow cells (bone marrow cells prepared in the same way as in Example 4) were supplemented with 20 ng/mL (final concentration) of FSTL1 and 20.0, 10.0, 5.0, or 2.5 µg/ml (final concentration) of the rat anti-FSTL1 antibody or #6-55. Also, mouse bone marrow cells were supplemented with 20.0 µg/ml (final concentration) each of their respective control antibodies, a rat IgG2b isotype control (R&D Systems, Inc., Cat. No. MAB0061, clone 141945) and an anti-DNP antibody. The cells were cultured for 8 days, and the inhibitory activity of each antibody against the induction of MSCs, cancer-associated MSCs, and M-MDSCs by FSTL1 was evaluated in the same way as in Example 13 (FIG. 104A). As a result, the inhibitory activity of the rat anti-FSTL1 antibody and the antibody of #6-55 was at the same level. On the other hand, dose dependence was not confirmed. The inhibition of regulatory T cells shown in Patent Literature 1 (WO2009/028411) is presumably a consequence mediated by the inhibition of MSC induction.

Example 16: Evaluation of Inhibitory Activity Against Induction of Mesenchymal Stem Cell (MSC) by FSTL1 (Evaluation of Ability to Differentiate into Adipocyte)

In this Example, the ability to differentiate into adipocytes was evaluated in order to evaluate inhibitory activity against an effect of inducing mesenchymal stem cell (MSC)-mediated immunosuppression by FSTL1.

In the same way as in Example 15, mouse bone marrow cells were supplemented with FSTL1 and the predetermined concentration of each antibody and cultured for 8 days. $5 \times 10^4$ cells/well were separated from each culture system and evaluated for the ability to differentiate into adipocytes using an adipocyte differentiation reagent included in "Mesenchymal Stem Cell Functional Identification Kit (R&D Systems, Inc., Cat. No. SC010)". For the evaluation method, the cells were supplemented with the adipocyte differentiation reagent and cultured for 8 days. Then, adipocytes per culture system were counted under a microscope for evaluation (FIG. 104B). As a result, cells differentiating into adipocytes decreased in number by the addition of #6-55 in a dose-dependent manner, as compared with the anti-DNP antibody (mouse IgG control group). On the other hand, in the case of adding the rat anti-FSTL1 antibody of R&D Systems, Inc., no influence was confirmed on differentiation into adipocytes, and a large number of adipocytes were observed at all of the doses, as in the rat IgG2b isotype control group. Specifically, not all of cells in a CD45-negative cell population are MSCs, and this population is merely a cell population containing MSCs at a high rate. It was shown that although the CD45-negative cells decreased in number by the rat anti-FSTL1 antibody of R&D Systems, Inc., there still remained many MSCs differentiating into adipocytes.

Example 17: In Vivo Antibody Activity Evaluation-Intratumoral Administration

In this Example, the drug efficacy of the anti-FSTL1 antibody was evaluated by intratumoral administration using bone metastasis models having a transplant of mouse melanoma B16-F10 cells forced to express Snail.

<Method and Material>

Three antibodies were comparatively analyzed for their antitumor effects and an immunosuppression-mitigating effect using bone metastasis models in which mouse melanoma cells B16-F10 forced to express Snail were subcutaneously and intravenously transplanted in C57BL/6N mice.
1. Experiment group (n=5)
1. No treatment
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5 \times 10^5$ cells subcutaneously & $1 \times 10^5$ cells intravenously)
Day 7: intratumoral administration of the antibody (200 µg/0.1 mL/tumor)
Day 14: various assays (with a focus on flow cytometry analysis)
3. Index for drug efficacy evaluation
Effects on the growth of subcutaneous tumor (calculation of tumor volume by tumor size measurement): measured 7, 11, and 14 days after tumor implantation (FIG. 105C)
Effects on bone metastasis (GFP-positive tumor cells in bone marrow) (FIG. 105A)
Effects on the expansion of mesenchymal stem cells (CD45-negative cells in bone marrow and in the spleen) (FIGS. 105B and 105D)
Effects on the expansion of immunosuppressive Treg cells (CD4-positive and Foxp3-positive cells in bone marrow or the spleen) (FIG. 105D)
Other immunosuppressive properties (FIG. 105D)

Description

In order to evaluate in vivo antibody activity, antitumor effects and immunosuppression-mitigating effects were comparatively analyzed using bone metastasis models in which mouse melanoma cells (B16-F10) forced to express Snail were subcutaneously and intravenously transplanted in C57BL/6N mice. An anti-FSTL1 antibody to be tested was administered into tumor. On day 0, GFP-positive and Snail-positive B16-F10 tumor cells ($5 \times 10^5$ cells subcutaneously & $1 \times 10^5$ cells intravenously) were transplanted. On day 7, the antibody was administered into subcutaneous tumor (200 µg/0.1 mL/tumor). On day 14, various assays were conducted.

It is known that when Snail-positive tumor cells are subcutaneously or intravenously transplanted to mice, the tumor metastasizes preferentially to bone marrow in addition to various organs, and this incurs the expansion of mesenchymal stem cells (MSCs) originating in the bone marrow, thereby systemically and strongly suppressing the induction of antitumor immunity (Cancer Research 73: 6185, 2013). Thus, GFP-positive and Snail-positive B16-F10 tumor cells forced to express GFP and Snail by the transfer of the GFP gene and the mouse Snail gene were transplanted subcutaneously ($5 \times 10^5$ cells) and into the tail vein ($1 \times 10^5$ cells). 7 days thereafter, 10 mg/kg of the anti-FSTL1 antibody (#6-55, #7-34, or #8-1) or its isotype control antibody mouse IgG (anti-DNP antibody) adjusted to 1 mg/ml with saline was inoculated into tumor (5 mice/group). First, subcutaneous tumor size was measured before assays, and the tumor volume was calculated to evaluate an inhibitory effect on subcutaneous tumor growth (FIG. 105C (change of each individual is shown)). 7 days after antibody administration (14 days after tumor implantation), bone marrow cells or spleen cells were collected from the mice, and the number of cells per mouse was counted while drug efficacy was comparatively analyzed in more detail by flow cytometry analysis using FACScan (Becton, Dickinson and Company). Specifically, a) the content of GFP-positive and Snail-positive B16-F10 tumor cells in the bone marrow cells was analyzed to evaluate an inhibitory effect on bone metastasis (FIG. 105A). The percentage (%) of $CD45^-$ cells in the bone marrow cells was analyzed by flow cytometry. Then, the number of CD45-negative bone marrow cells ($\times 10^6$ cells) per mouse was counted on the basis of this data (FIG. 105B). The effects of various antibodies on MSC expansion in bone marrow are shown. b) The content of CD45-negative cells in the spleen was analyzed (PE-Cy5-labeled anti-CD45 antibody, Becton, Dickinson and Company) to evaluate an inhibitory effect on MSC expansion (left graph of FIG. 105D). c) The contents of immunosuppressive CD4-positive and Foxp3-positive cells (PE-labeled anti-CD4 antibody, Becton, Dickinson and Company; FITC-labeled anti-Foxp3 antibody, eBioscience) (middle graph of FIG. 105D) which are reportedly induced by MSCs, and CD8-positive and Tim3-positive T cells (CyChrome-labeled anti-CD8 antibody, Becton, Dickinson and Company; FITC-labeled anti-Tim3 antibody, R&D Systems, Inc.) exhausted to fall into dysfunction (right graph of FIG. 105D) were analyzed in bone marrow or the spleen to evaluate an immunosuppression-mitigating effect.

(Results)

The results are shown in FIG. 105. Antitumor effects and immunosuppression-mitigating effects, etc. were comparatively analyzed using bone metastasis models in which mouse melanoma cells (B16-F10) forced to express Snail were subcutaneously and intravenously transplanted in C57BL/6N mice. Intratumoral administration was performed as a method for administering the anti-FSTL1 antibody to be tested. All of the 3 anti-FSTL1 antibodies significantly suppressed the growth of subcutaneous tumor with respect to the control antibody. However, bone metastasis was suppressed by only #6-55 and #8-1, and no suppressive effect was seen in #7-34. FIG. 105D shows change in cell populations in the spleen. As shown, even if an antibody is administered locally, for example, into tumor, the whole body receives modification or influence. The left graph of FIG. 105D shows the number of CD45-negative cells and shows that MSCs also decrease in number in the spleen. The middle graph of FIG. 105D shows that CD4-positive and Foxp3-positive T cells decrease in number and shows that Tregs (regulatory T cells) decrease in number. The right graph of FIG. 105D shows the number of CD8-positive and Tim3-positive T cells and demonstrated that exhausted CD8-positive T cells decrease in number. In this context, the "exhaustion" refers to a state having functional decline or dysfunction. Tim3 is a marker that reflects the state. If CD8-positive T cells supposed to kill tumor cells fall into an exhausted state, cancer cells cannot be eliminated from the living body. Thus, it can be concluded that the effects of the present invention exhibit remarkable effects of suppressing the enhancement of such immunosuppression.

Example 18: In Vivo Antibody Activity Evaluation-Intraperitoneal Administration

In this Example, the drug efficacy of the anti-FSTL1 antibody was evaluated by systemic administration (intraperitoneal administration) using bone metastasis models having a transplant of mouse melanoma B16-F10 cells forced to express Snail.
1. Experiment group (n=5)
1. No treatment (0.9% NaCl as a sham)
2. Control IgG (anti-DNP)
3. Anti-FSTL1 Clone #6-55
4. Anti-FSTL1 Clone #7-34
5. Anti-FSTL1 Clone #8-1
2. Experimental procedure
Day 0: transplantation of GFP-positive and Snail-positive B16-F10 tumor cells ($5 \times 10^5$ cells subcutaneously & $1 \times 10^5$ cells intravenously)
Day 5: intraperitoneal administration of the antibody (first dose, corresponding to 200 µg/mouse=10 mg/kg)
Day 10: intraperitoneal administration of the antibody (second dose, corresponding to 200 µg/mouse=10 mg/kg)
Day 14: various immunological assays
    The intraperitoneal administration and the intravenous administration are pharmacologically used interchangeably with systemic administration methods.
3. Index for drug efficacy evaluation
    Effects on the growth of subcutaneous tumor (calculation of tumor volume by tumor size measurement): measured 7, 11, and 14 days after tumor implantation (FIG. 106B)
    Effects on bone metastasis (GFP-positive tumor cells in bone marrow or the spleen) (FIGS. 106A and 106C)
    Effects on MSC expansion (CD45-negative cells in bone marrow or the spleen) (FIGS. 106A and 106C)
    Effects on weight loss (FIG. 106A)
    Effects on the expansion of immunosuppressive Treg cells (CD4-positive and Foxp3-positive cells in the spleen) (FIG. 106C)
    Other immunosuppressive properties (FIG. 106C)

DESCRIPTION

In Example 17, the antibody was administered into tumor according to the purpose of "inhibiting metastasis from a primary focus to bone" as previously conducted by the present inventors. In this Example, the conditions of Example 17 were changed, and intraperitoneal administration generally performed in mouse experiments was adopted in consideration of the fact that antibody drugs are systemically administered in general. All procedures except for the antibody administration method were performed in the same way as in Example 17 above. Specifically, antitumor effects and immunosuppression-mitigating effects were comparatively analyzed by the intraperitoneal administration (systemic administration) of the anti-FSTL1 antibody using bone metastasis models in which mouse melanoma cells (B16-F10) forced to express Snail were subcutaneously and intravenously transplanted in C57BL/6N mice.

Also, assays were conducted 14 days after tumor implantation. The antibody was intraperitoneally administered at 10 mg/kg twice (5 and 10 days after tumor implantation) to the mice.

(Results)

The results are shown in FIG. 106. Intraperitoneal administration was performed as a method for administering the anti-FSTL1 antibody to be tested here. In in vivo evaluation, as in Example 17, all of the 3 anti-FSTL1 antibodies significantly suppressed the growth of subcutaneous tumor with respect to the control antibody (FIG. 106B). In addition, an anti-weight loss effect (right graph of FIG. 106A) was confirmed by the administration of #6-55 and #8-1. In light of these functional analysis results, even decrease in the number of Tregs, which has heretofore received attention in terms of immunosuppression, or the removal of the Tregs is not sufficient treatment for cancer treatment. Instead, the control of the whole immunosuppression cascade should be contemplated. It is expected that the targeting of MSCs positioned most upstream thereof is more effective. It can also be reconfirmed that the inhibition of even cancer metastasis (middle graph of FIG. 106A) at the same time with decrease in the number of MSCs (left graph of FIG. 106A) is further effective. The possibility is expected that inhibitory treatment targeting FSTL1 is effective for cancer treatment. FIG. 106C shows change in cell populations in the spleen. The upper left graph of FIG. 106C shows the number of GFP-positive tumor cells and shows that as a result of also examining metastasis into the spleen, this was also suppressed. This indicates metastasis to other organs. The upper right graph shows the number of CD45-negative cells and shows that MSCs also decrease in number in the spleen. The lower left graph shows the number of CD4-positive and Foxp3-positive T cells and shows that Tregs decrease in number. The lower right graph shows the number of CD8-positive and Tim3-positive T cells and shows that exhausted CD8-positive T cells decrease in number.

Example 19: In Vivo Antibody Activity Evaluation-Comparison with Existing Drug

In this Example, drug efficacy was compared between existing antibody drugs for mitigation of immunosuppression and the anti-FSTL1 antibody using bone metastasis models having a transplant of mouse melanoma B16-F10 cells forced to express Snail.

DESCRIPTION

Procedures and methods of the experiment were substantially the same as in Examples 17 and 18, and assays were conducted 15 days after tumor implantation.

An antibody given below was intraperitoneally administered as an existing drug at 10 mg/kg (200 µg/mouse) twice (4 and 8 days after tumor implantation) to the mice.

In this Example, therapeutic effects were comparatively studied using antibody drugs already clinically used for the purpose of "mitigation of immunosuppression", which is one mechanism of action of the anti-FSTL1 antibody, and Snail-positive tumor bone metastasis models. The antibody was systemically administered twice, as in the preceding test, according to general animal tests using antibody drugs.
1 Experiment group (n=5)
1 No treatment (0.9% NaCl as a sham)
2 Control IgG (anti-DNP)
3 Anti-FSTL1 mAb (#6-55)
4 Anti-CTLA4 mAb (Clone 9H10, BioLegend)
5 Anti-PD-1 mAb (Clone 29F.1A12, BioLegend)
6 Anti-PD-L1 mAb (Clone 10F.9G2, BioLegend)
7 Naive (no tumors, no treatment)
2 Experimental procedure
Day 0: transplantation of GFP-positive and Snail-positive B16-F10 tumor cells ($5 \times 10^5$ cells subcutaneously & $1 \times 10^5$ cells intravenously)
Day 4: intraperitoneal administration of the antibody (first dose, corresponding to 200 µg/mouse=10 mg/kg)
Day 8: intraperitoneal administration of the antibody (second dose, corresponding to 200 µg/mouse=10 mg/kg)
Day 15: various assays
3. Index for drug efficacy evaluation
   Effects on the growth of subcutaneous tumor (calculation of tumor volume by tumor size measurement): measured 8, 11, and 14 days after tumor implantation (FIG. 107A)
   Effects on bone metastasis (amount of GFP-positive tumor cells in bone marrow) (FIG. 107B)
   Effects on MSC expansion in bone marrow (FIG. 107B)
   Effects on weight loss (FIG. 107B)
(Results)

The results are shown in FIG. 107. In all of the treatment groups, all of subcutaneous tumor growth, bone metastasis, and expansion of mesenchymal stem cells (MSCs) increasing in number in association with bone metastasis were significantly suppressed, as compared with the control antibody administration group, demonstrating that the anti-FSTL1 antibody exerts an antitumor effect equivalent to that of the existing drugs. However, in the anti-CTLA4 antibody administration group and the anti-PD-1 antibody administration group, emaciation, such as remarkable fluffing, decreased physical activity, and weight loss, caused by bone metastasis was not ameliorated. Also, a large difference was macroscopically seen between the anti-FSTL1 antibody administration group and the anti-PD-L1 antibody administration group.

Example 20: In Vivo Antibody Activity Evaluation-Colorectal Cancer Model

In this Example, the drug efficacy of the anti-FSTL1 antibody was evaluated using mouse colorectal cancer CT26 cell-transplanted models.

Procedures and methods of the experiment were basically performed under substantially the same conditions as in the bone metastasis model experiments of Examples 17 to 19 except that bone metastasis was not evaluated. Specifically, drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The test was conducted by changing only the amount of tumor implanted, antibody administration timing, and assay timing.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth (FIG. 108A) and lung metastasis (FIG. 108B))

For lung metastasis, the number of metastatic nodules in the lung was macroscopically counted. The tumor volumes of the mice were measured 7, 11, and 14 days after tumor implantation.

(Results)

The results are shown in FIG. 108. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. The results about the number of metastatic nodules in the lung are shown in FIG. 108B. The left bar depicts no treatment, the middle bar depicts an isotype control (anti-DNP antibody), and the right bar depicts the anti-FSTL1 antibody. The ordinate shows the number of metastatic nodules in the lung. Standard deviation bars are shown in the numerical values of the ordinate. The anti-FSTL1 antibody (#6-55) very strongly suppressed the growth and lung metastasis of CT26 subcutaneous tumor. Solid tumor disappeared in three out of the five mice, and the number of metastatic nodules in the lung was also very few (14 nodules on average of the control antibody group vs. approximately 0 to 3 nodules in the anti-FSTL1 antibody group). This result indicates the data that not only metastasis to "bone" but metastasis to the "lung" is inhibited. Therefore, it is understood that the antibody of the present invention is effective against general cancer metastasis.

Example 21: In Vivo Antibody Activity Evaluation-Breast Cancer Model

In this Example, the drug efficacy of the anti-FSTL1 antibody was evaluated using mouse breast cancer 4T1 cell-transplanted models.

Procedures and methods of the experiment were basically performed according to Examples 17 to 20 under substantially the same conditions as in the bone metastasis model experiments of Examples 17 to 20. Drug efficacy evaluation was conducted using mouse tumor models other than Snail-positive tumor bone metastasis models. The drug efficacy of the anti-FSTL1 antibody was evaluated using cancer-bearing models of BALB/c mice different in strain from the C57BL/6 mice used in the preceding tests. Changes were made as follows.
Day 0: transplantation of tumor cells ($5 \times 10^5$ cells subcutaneously & $5 \times 10^5$ cells intravenously)
Days 4 and 7: intraperitoneal administration of the antibody (10 mg/kg)
Day 14: drug efficacy evaluation (subcutaneous tumor growth)

The tumor volumes of the mice were measured 4, 7, 11, and 14 days after tumor implantation.
(Results)

The results are shown in FIG. 109. The growth of 4T1 subcutaneous tumor was able to be significantly suppressed by the administration of the anti-FSTL1 antibody (#6-55).

Example 22: In Vivo Antibody Activity Evaluation-Melanoma B16-10

In this Example, the drug efficacy of the anti-FSTL1 antibody was evaluated using mouse melanoma B16-F10.

The drug efficacy of the anti-FSTL1 antibody was evaluated according to Examples 17 to 20 using other cancer-bearing models of C57BL/6 mice of the same strain as in Snail-positive tumor bone metastasis models. The "mouse melanoma B16-F10" is a parent line of the cell line forced to express Snail, which was transplanted in the bone metastasis models used in the preceding tests.

1. Experiment group (n=5)
1. Mouse melanoma B16-F10+control IgG (anti-DNP mAb)
2. Mouse melanoma B16-F10+anti-FSTL1 mAb (#6-55)
2. Experimental procedure
Day 0: transplantation of tumor cells ($1 \times 10^6$ cells subcutaneously & $1 \times 10^6$ cells intravenously)
Day 3: intraperitoneal administration of the antibody (first dose, corresponding to 200 µg/mouse=10 mg/kg)
Day 6: intraperitoneal administration of the antibody (second dose, corresponding to 200 µg/mouse=10 mg/kg)
Day 15 various immunological assays
3. Index for drug efficacy evaluation
   Effects on the growth of subcutaneous tumor (calculation of tumor volume by tumor size measurement): measured 6, 10, and 14 days after tumor implantation (FIG. 110A)
   Effects on weight loss (FIG. 110B)
(Results)

The results are shown in FIG. 110. Subcutaneous tumor growth was strongly suppressed by the administration of the anti-FSTL1 antibody (#6-55), as compared with the control antibody administration group. In the anti-FSTL1 antibody administration group, suppressive activity against weight loss was also exhibited (FIG. 110A), and neither remarkable emaciation nor fluffing, etc. was observed (FIG. 110B). Thus, all of the mice were fine. In this model, lung metastasis is usually observed 20 to 30 days after implantation. This evaluation was conducted approximately 2 weeks after implantation according to the timing in the preceding tests. Therefore, no metastatic nodule in the lung was macroscopically observed.

Example 23: In Vivo Antibody Activity Evaluation-Lymphoma

In this Example, the drug efficacy of the anti-FSTL1 antibody was evaluated using mouse lymphoma EL4.

The drug efficacy of the anti-FSTL1 antibody was evaluated according to Examples 17 to 20 using mouse lymphoma EL4, which is a cancer type having enhanced FSTL1 expression.
1. Experiment group (n=5)
1. Mouse lymphoma EL4+control IgG (anti-DNP mAb)
2. Mouse lymphoma EL4+anti-FSTL1 mAb (#6-55)
2. Experimental procedure
Day 0: transplantation of tumor cells ($1 \times 10^6$ cells subcutaneously & $1 \times 10^6$ cells intravenously)
Day 3: intraperitoneal administration of the antibody (first dose, corresponding to 200 µg/mouse=10 mg/kg)
Day 6: intraperitoneal administration of the antibody (second dose, corresponding to 200 µg/mouse=10 mg/kg)
Day 15: various immunological assays
3. Index for drug efficacy evaluation
   Effects on the growth of subcutaneous tumor (calculation of tumor volume by tumor size measurement): measured 3, 6, and 10 days after tumor implantation
(Results)

The results are shown in FIG. 111. Subcutaneous tumor growth was strongly suppressed by the administration of the anti-FSTL1 antibody (#6-55), as compared with the control antibody administration group. This model manifests the very aggressive growth of subcutaneous tumor, as compared with other tumor models. Nonetheless, the administration of the anti-FSTL1 antibody exhibited significant suppression, as compared with the control antibody administration group. It can be concluded that the proven effectiveness for lymphoma, one highly FSTL1-expressing cancer type comparable to breast cancer, is very useful data for developing clinical trials.

Example 24: In Vivo Antibody Activity Evaluation-Melanoma B16-10, Subcutaneous Transplantation In this Example, the drug efficacy of the anti-FSTL1 antibody was evaluated using mouse melanoma B16-F10.

The drug efficacy of the anti-FSTL1 antibody was evaluated in the same test system as in Example 22 according to Examples 17 to 20 except that only subcutaneous transplantation was performed here in order to more clearly evaluate reactivity.
1. Experiment group (n=5)
1. Control IgG (anti-DNP), 10 mg/kg
2. Anti-FSTL1 mAb (#6-55), 1 mg/kg
3. Anti-FSTL1 mAb (#6-55), 3 mg/kg
4. Anti-FSTL1 mAb (#6-55), 10 mg/kg
2. Experimental procedure
Day 0: subcutaneous transplantation of mouse melanoma B16-F10 cells ($1\times10^6$ cells)
Day 4: intraperitoneal administration of the antibody (first dose)
Day 8: intraperitoneal administration of the antibody (second dose)
Day 15: various immunological assays
3. Index for drug efficacy evaluation
  Effects on the growth of subcutaneous tumor (calculation of tumor volume by tumor size measurement): measured 6, 10, and 14 days after tumor implantation
(Results)

The results are shown in FIG. 112. At all of the studied doses, the administration of the anti-FSTL1 antibody strongly suppressed subcutaneous tumor growth, as compared with the control antibody administration group. In the 3 mg/kg administration group and the 10 mg/kg administration group, tumor disappearance in mice was observed, and substantially dose-dependent drug efficacy was observed.

<Example 25: Treg induction inhibitory activity of anti-FSTL1 antibody using human peripheral blood cell>

In this Example, the Treg induction inhibitory activity of the anti-FSTL1 antibody was evaluated using human peripheral blood cells.

Human peripheral blood cells ($1\times10^6$ cells) were stimulated using FSTL1 (5 ng/ml), supplemented with the antibody (5 μg/mL), and cultured for 3 days. The percentage of a Foxp3$^+$CTLA4$^+$ cell fraction (Exp. 1) or a CD4$^+$Foxp3$^+$CTLA4$^+$ cell fraction (Exp. 2) in CD4$^+$ T cells was analyzed as Treg cells by flow cytometry. The flow cytometry conditions are as follows.

Blood was collected from a healthy person by the addition of a 1/10 amount of 4% sodium citrate, then layered on Ficoll (specific gravity: 1.090), and centrifuged (1500 rpm, 20 min, room temperature), and a cell fraction present in an intermediate layer was used as "PBMCs". The antibody (5 μg/mL) was added to a system in which these PBMCs ($1\times10^6$ cells) were cultured for 3 days under stimulation with FSTL1 (5 ng/ml) in a 24-well plate. PBMCs recovered from the culture system were incubated at 4° C. for 1 hour using an anti-CD4 antibody (BD Pharmingen/Becton, Dickinson and Company), an anti-CD25 antibody (BD Pharmingen/Becton, Dickinson and Company), and an anti-FoxP3 antibody (eBioscience). Then, the percentage of a Foxp3$^+$CTLA4$^+$ cell fraction (Exp. 1) or a CD4$^+$Foxp3$^+$CTLA4$^+$ cell fraction (Exp. 2) in CD4$^+$ T cells contained therein was analyzed as Treg cells using a flow cytometer FACScan (Becton, Dickinson and Company).

FIG. 113 summarizes these data and results in a table. The double circle, the circle, and the triangle depict statistical significance and represent 30% or more decrease, 10% to 30% decrease, and less than 10% decrease, respectively. The cross mark represents the absence of statistically significant difference. The results revealed that Tregs remarkably increase in number by stimulation with FSTL1, as with TGFb, etc., and this is significantly suppressed by the addition of antibody #6-55 of the present invention (the difference of Exp. 1 from Exp. 2 or 3 is based on difference in peripheral blood donor). On the other hand, a known antibody R&D antibody (R&D Systems, Inc., Cat. No. MAB1694, clone 229007) hardly exhibited inhibition. Here, the superiority of antibody #6-55 of the present invention was also confirmed again. These results indicated that antibody #6-55 of the present invention can remarkably inhibit Treg induction caused by FSTL1.

Example 26: Influence of Anti-FSTL1 Antibody on Proliferative Capacity and Invasive Capacity of Various Human Tumor Cells, Etc.

In this Example, the influence of the anti-FSTL1 antibody on the proliferative capacity and invasive capacity of various human tumor cells, the action of the anti-FSTL1 antibody under FSTL1 stimulation, and the action of the anti-FSTL1 antibody on cells forced to express Snail were examined.

Specifically, the influence of the anti-FSTL1 antibody on proliferative capacity and invasive capacity was studied using various human tumor cells, regardless of the presence or absence of the expression of Snail or FSTL1. Specifically, the anti-FSTL1 antibody (#6-55, 5 μg/ml) or a control antibody (aHema: mouse chimeric anti-hemagglutinin antibody, 5 μg/ml) was added to systems in which a pancreatic cancer cell line Pancl (ATCC # CRL-1469), Pancl-snail+ which is a Pancl cell line forced to express Snail, a pancreatic cancer cell line MIAPaCa (ATCC # CRL-1420), a bone metastatic breast cancer cell line MDA231 (ATCC # HTB-26), and a melanoma cell line Hs294T (ATCC # HTB-140) were each cultured at $1\times10^5$ cells. After culture for 3 days, the number of cells per culture system was counted to evaluate the proliferative capacity of the cells. The cells ($5\times10^4$ cells) after the counting were further inoculated to Matrigel-coated transwell chamber (Corning Inc. #354480) and cultured for 4 hours. Then, the membranes were removed, and stained and fixed with Crystal Violet fixative. Then, the number of cells that permeated the membranes was counted under a microscope to evaluate the invasive capacity of the cells. As a result, both proliferative capacity and invasive capacity were strongly suppressed, particularly, in a highly metastatic tumor cell line highly expressing Snail. This indicated that the anti-FSTL1 antibody acts particularly on tumor cells highly expressing FSTL1 and having EMT (FIG. 114A).

(Action of Anti-FSTL1 Antibody Under FSTL1 Stimulation)

Next, in order to examine how surrounding tumor cells were changed in a cancer microenvironment by receiving FSTL1 produced by Snail/FSTL1-expressing cells, and how the anti-FSTL1 antibody acts thereon, a human pancreatic cancer cell line Pancl confirmed to express Snail or FSTL1 only slightly was stimulated with FSTL1 for 3 days. The anti-FSTL1 antibody (#6-55, 5 μg/ml) or a control antibody (aHema, 5 μg/ml) was added to this culture system, and subsequent change in cell function was analyzed in the same way as in the preceding paragraph. As a result, as previously reported in the paper (Cancer Res; 73 (20); 6185-93, 2013), FSTL1 had little influence or contribution on or to tumor growth, whereas the cell growth was reduced by the addition of the anti-FSTL1 antibody together with FSTL1. The paper also reports that FSTL1 enhances invasive capacity. It was revealed that the action thereof is canceled (FIG. 114B).

(Action of Anti-FSTL1 Antibody on Cell Forced to Express Snail)

Cell invasion was evaluated in the presence of the anti-FSTL1 antibody (#6-55, 5 µg/ml) or a control antibody (aHema, 5 µg/ml) in a chamber using Pancl-snail+, a cell line forced to express Snail, instead of the FSTL1-stimulated tumor cells of the preceding paragraph. The results are very similar to the results of the preceding paragraph, and suppressive activity was able to be confirmed in 6-55 (FIG. 114C)).

In this Example, Pancl-snail+ cells were cultured for 3 days in the presence of the added antibody. Then, the expression of CCR2 and RANKL among molecules known as bone metastasis markers was analyzed by flow cytometry. As a result, both CCR2 and RANKL were strongly suppressed by the anti-FSTL1 antibody. The anti-FSTL1 antibody presumably has inhibitory activity against cell invasion (FIG. 114D).

Example 27: MSC Induction Inhibition Test Using Mouse Bone Marrow Cell

In this Example, the inhibitory activity of the anti-FSTL1 antibody was confirmed in an experimental system of mesenchymal stem cell induction while a FSTL1 inhibitory effect on MSC expansion induced not only by FSTL1 but by Snail+ tumor cells was also evaluated. For specific operation, each antibody (10 µg/mL) was added to systems in which C57/BL/6 mouse-derived bone marrow cells were stimulated with FSTL1 (20 ng/mL) or a culture supernatant of tumor cells. After culture for 8 days under stimulation, cell fraction CD45(−) cells (MSCs) containing MSCs at a high rate and CD45(−)CD146(+)ALCAM(+) cells (sMSCs) increasing in number in association with cancer metastasis were analyzed by flow cytometry in the same way as in Example 14, and the number of cells per culture system was counted. In this Example, mouse immunoglobulin manufactured by BioLegend, Inc. (#401408, Cone MG1-45) was used as a control antibody.

The results are shown in FIG. 115. As shown in FIG. 115A, in the MSC induction inhibition test of this Example, #7, #10, #13, and #33 exhibited a strong inhibitory effect equivalent to or higher than that of #6-55 in flow cytometry analysis. As a result, #7, #10, and #33 exhibited high MSC induction inhibitory activity equivalent to or higher than that of #6-55, and reproducibility was able to be confirmed in these 3 clones.

(Influence on MSC Expansion Induced by Tumor Cell)

In this Example, whether or not the anti-FSTL1 antibody could inhibit MSC expansion induced by a culture supernatant of Snail+ tumor cells was evaluated in a MSC induction system using bone marrow cells. C57/BL/6 mouse-derived bone marrow cells were supplemented with the culture supernatant of Snail+ tumor cells and each antibody (10 µg/mL) and cultured for 8 days under stimulation. Then, the following 2 cell groups were analyzed by flow cytometry.

1) General cell fraction "CD45(−) cells" containing MSCs at a high rate

2) "CD45(−)ALCAM(+)CD271(+) cells (=sMSCs)" increasing in number in association with cancer metastasis Formed sphere colonies were classified into large colonies each formed by 50 or more cells and small colonies each formed by 50 or less cells, and observed under a microscope on culture day 8. As a result, as shown in FIGS. 115B to 115D, the induction of MSCs and sMSCs was remarkably inhibited, and the formation of sphere colonies exhibiting the ability to self-renew, which typifies the nature of stem cells, was also strongly suppressed. This suggested the possibility that the FSTL1 antibody exerts an antitumor effect in vivo by inhibiting the induction of MSCs amplified by cancer metastasis.

Example 28: Treg Induction Inhibition Test Using Mouse Spleen Cell

In this Example, newly prepared 3 anti-FSTL1 antibodies differing in epitope were evaluated for their inhibitory activity against Treg induction in a mouse system.

(Material and Method)

In this Example, the experiment was conducted according to Example 17. Specifically, 5 µg/mL of each antibody was added to a system in which C57/BL/6 mouse-derived spleen cells ($2 \times 10^6$ cells) were stimulated with 5 ng/ml of FSTL1. After culture for 3 days, the percentage (%) of a Foxp3+ CTLA4+ cell fraction in CD4+ T cells was analyzed as Treg cells by flow cytometry. Activity was compared with #6-55 used in the preceding studies.

(Results)

As a result, as shown in FIG. 116, all of the new 3 clones suppressed Treg induction, as compared with the control antibody. Particularly, #7 and #10 exhibited strong suppressive activity equal to or higher than that of #6-55. The Treg induction inhibitory activity of the anti-FSTL1 antibody was also able to be properly confirmed in a human evaluation system using human peripheral blood cells in other Examples. High-impact inhibitory activity was more clearly observed in this mouse evaluation system in this Example. Both #7 and #10 are clones recognizing 205-228 a.a. of FSTL1, indicating that in addition to 148-162 a.a. recognized by #6-55, 205-228 a.a. is also a region important for the activity of FSTL1.

Example 29: Inhibitory Activity of Newly Prepared 3 Anti-FSTL1 Antibodies Differing in Epitope Against Mouse Tumor Activation In this Example, newly prepared 3 anti-FSTL1 antibodies differing in epitope were evaluated for their inhibitory activity against mouse tumor activation.

(Material and Method)

A melanoma cell line F10-snail+ forced to express mouse Snail was supplemented with 5 µg/ml of the anti-FSTL1 antibody or a control antibody (anti-DNP antibody) and cultured for 3 days, and change in the properties of tumor cells was analyzed by various assays. Cell adhesion ability was evaluated by culturing the cells for 2 hours using a fibronectin-coated plate, and then counting the number of cells that adhered to the plate. The invasive capacity of the cells was evaluated by culturing the cells for 4 hours using Matrigel-coated transwell chamber, and then counting the number of cells that permeated the membrane. As for bone metastasis-associated molecule expression, the expression of typical molecular markers CCR2 and RANKL was analyzed by flow cytometry.

(Results)

As shown in FIG. 117, all of the new clone antibodies significantly reduced the expression of CCR2 and RANKL and the invasive capacity of the cells and enhanced cell adhesion, as compared with the control antibody. This means that the cells were converted to epithelial cells. Both activities were substantially equivalent to those of #6-55, and no large difference was seen.

Example 30: In Vivo Drug Efficacy Comparison Between Antibody Drug for Immune Mitigation Already Used Clinically and Anti-FSTL1 Antibody Using Snail+ Tumor Bone Metastasis Model Drugs for immune mitigation such as anti-CTLA4 antibodies have received attention because their administration into tumor can directly ameliorate an immunosuppressed environment in the tumor acting advantageously to cancer cells, and can effectively enhance antitumor immunity (Clin Cancer Res 20: 1747, 2014). Thus, in vivo drug efficacy was compared between antibody drugs for immune mitigation already used clinically and the anti-FSTL1 antibody using $Snail_+$ tumor bone metastasis models.

(Material and Method)
1. Experimental protocol
1-1. Experiment group (n=5)
1. No treatment (0.9% NaCl as a sham)
2. Control mouse IgG (mouse chimeric anti-hemagglutinin antibody, also referred to as aHema)
3. Anti-CTLA4 mAb (Clone 9H10, BioLegend)
4. Anti-PD1 mAb (Clone 9F.1A12, BioLegend)
5. Anti-PDL1 mAb (Clone 10F.9G2, BioLegend)
6. Anti-FSTL1 mAb (#6-55)
7. Naive (no tumors, no treatment)
1-2. Experimental procedure
Day 0: transplantation of GFP+ Snail+B16-F10 tumor cells ($3×10^5$ cells subcutaneously & $2×10^4$ cells intravenously)
Day 5: intratumoral administration of the antibody (corresponding to 200 μg/mouse=10 mg/kg)
Day 14: various assays
1-3. Index for drug efficacy evaluation
The following was used as an index for drug efficacy evaluation.
Effects on the growth of subcutaneous tumor (calculation of tumor volume by tumor size measurement)
Effects on bone metastasis (amount of $GFP^+$ tumor cells in bone marrow)
Effects on sMSC expansion in bone marrow or the spleen
Influence on the immune system (Procedure)
The tumor volumes of the mice were measured 5, 7, 10, and 14 days after tumor implantation. Methods for evaluating effects on subcutaneous tumor growth, bone metastasis, and sMSC expansion in bone marrow and the spleen were performed in the same way as in Example 17. In order to evaluate influence on the immune system, the contents and numbers of $CD4^+$ T cells ($CD45^+CD3^+CD4^+$; FITC-labeled anti-CD3 antibody, PE-labeled anti-CD4 antibody, and Cy5-labeled anti-CD45 antibody, all from Becton, Dickinson and Company), tumor-specific $CD8^+$ T cells ($CD45^+CD8^+$ tetramer$^+$; FITC-labeled anti-CD8 antibody manufactured by Becton, Dickinson and Company, PE-labeled tetramer manufactured by Medical & Biological Laboratories Co., Ltd. (MBL), and Cy5-labeled anti-CD45 antibody), activated NK cells ($CD45^+NK1.1^+NKG2D^+$; FITC-labeled anti-NK1.1 antibody, PE-labeled anti-NKG2D antibody, and Cy5-labeled anti-CD45 antibody, all from Becton, Dickinson and Company), immunosuppressive T cells ($CD45^+CD4^+FOXP3^+$ Tregs; FITC-labeled anti-Foxp3 antibody manufactured by eBiosciences, PE-labeled anti-CD4 antibody, and Cy5-labeled anti-CD45 antibody), and MDSCs ($CD45^+CD11b^+Gr1+$ MDSCs; FITC-labeled anti-CD11b antibody, PE-labeled anti-Gr1 antibody, and Cy5-labeled anti-CD45 antibody, all from Becton, Dickinson and Company), which were cell groups in charge of antitumor immunity that invaded tumor, were analyzed by flow cytometry. Also, the content and number of highly metastatic tumor cells ($Snail^+CD44^+$ tumors; PE-labeled anti-Snail antibody manufactured by eBiosciences and Cy5-labeled anti-CD44 antibody manufactured by Becton, Dickinson and Company) in subcutaneous tumor was analyzed by flow cytometry.

(Results)
The growth of subcutaneous tumor was significantly suppressed in all of the treatment groups compared with the control antibody administration group, and no significant difference was confirmed among the treatment groups (FIG. 118-1). However, bone metastasis and MSC induction in bone marrow and the spleen were significantly suppressed by the FSTL1 antibody, whereas the CTLA4 antibody and the PDL1 antibody rather enhanced bone metastasis, and the PDL1 antibody did not inhibit MSC induction in bone marrow (FIG. 118-1). As a result of culturing bone marrow cells, the properties of tumor cells present therein differ between both groups. A large number of sphere colonies were formed in the CTLA4 antibody administration group, whereas strong adhesive properties were exhibited in the PDL1 antibody administration group.

On the other hand, as a result of analyzing immunocyte groups (TILs) that received the antibody and invaded subcutaneous tumor, a large number of $CD4^+$ T cells, tumor-specific $CD8^+$ T cells, and activated NK cells invaded tumor in all of the treatment groups (FIG. 118-2). Particularly, these antitumor effector cell groups were found to exceedingly remarkably increase in number by the intratumoral administration of the CTLA4 antibody. Interestingly, a larger number of activated NK cells, which have neither received attention nor been analyzed so far, than the number of tumor-specific $CD8^+$ T cells invaded tumor in the FSTL1 antibody group, as with this CTLA4 antibody group (FIG. 118-2). NK cells are major effector cells of the natural immune system, as with MSC, and have also been reported as cells most susceptible to a suppressive effect by MSCs. Thus, the number or functions of NK cells were presumably improved or enhanced drastically because MSCs drastically decreased in number by the administration of the FSTL1 antibody.

As mentioned above, the antitumor effector cell groups increased in number in all of the treatment groups. Referring to the immunosuppressive cell groups, Tregs or MDSCs rather increased in number in the tumor of the existing antibody drug administration groups. Particularly, the MDSC expansion was markedly seen in the CTLA4 antibody administration group and the PDL1 antibody administration group (FIG. 118-3). Also, the CTLA4 antibody was unable to suppress Treg expansion in the spleen, and CD8+ Tregs increased in number (FIG. 118-4). This may be a rebounding effect after a lapse of days after administration, or a feedback phenomenon in which other immunosuppressive cell groups attempted to compensate for a part where CD4+ Tregs decreased in number. In an intratumoral environment, it is possible that tumor cells are stimulated by, for example, cytokines released by immunocytes that have invaded the environment, to induce EMT, etc. Therefore, change in tumor cells was also confirmed. First, the expression of main EMT marker Snail/CD44 was analyzed. As a result, the original tumor cells used in transplantation were Snail+CD44+, whereas a subpopulation fraction with the enhanced expression intensity of these markers was seen in tumor cells separated from subcutaneous tumor, demonstrating that EMT was rather promoted by treatment (FIG. 118-3). This de novo EMT was particularly markedly seen in the CTLA4 antibody administration group and the PDL1 antibody administration group in which MDSCs increased in number and bone metastasis was also aggravated. As seen from these results, the CTLA4 antibody and the PDL1 antibody were certainly able to recruit antitumor immunity-enhancing members into tumor to suppress tumor growth, but were unable to suppress the expansion of immunosuppressive cell groups, de novo EMT in tumor cells, etc. Therefore, systemic antitumor immunity was not ameliorated. As a result, presumably, bone metastasis was unable to be sufficiently inhibited. On the other hand, no major weak point was seen in data on the PD1 antibody. Particularly, the volume of bone metastasis or the amount of sMSCs is probably attributed to the very drastically decreased number of bone marrow cells. In other words, when the bone marrow cells of the PD1 antibody administration group were cultured, a large number of tumor cells formed colonies, as with the CTLA4 antibody administration group. In actuality, bone metastasis was probably rather aggravated, and tumor cells presumably accumulated in large amounts or grew excessively in a bone environment so that the growth of bone marrow cells was suppressed to drastically decrease the number of cells. The CTLA4 antibody was found to effectively recruit antitumor effector cells into tumor in this intratumoral administration compared with systemic administration. On the other hand, the FSTL1 antibody has a high effect of suppressing inferior parts, but does not have a much high effect of recruiting antitumor effector cells.

Example 31: Mouse Lung Cancer Model

In this Example, drug efficacy was evaluated using mouse lung cancer models in anticipation of the development of the anti-FSTL1 antibody as a therapeutic drug for lung cancer.
(Material and Method)
Experimental protocol
Experiment group (n=5)
1. Isotyoe mouse IgG (aHema)
2. Anti-FSTL1 mAb (#6-55)
3. Normal mice
1-2. Experimental procedure
Day 0: transplantation of mouse lung cancer 3LL cells ($1\times10^6$ cells subcutaneously & $5\times10^5$ cells intravenously)
Day 3: intraperitoneal administration of the antibody (first dose, corresponding to 200 µg/mouse=10 mg/kg)
Day 7: intraperitoneal administration of the antibody (second dose, corresponding to 200 µg/mouse=10 mg/kg)
Day 14: various immunological assays
1-3. Index for drug efficacy evaluation
  Effects on subcutaneous tumor growth (calculation of tumor volume by tumor size measurement)
  Ameliorating effect on mouse emaciation (measurement of mouse body weight)
  Effects on MSC expansion (CD45− cells in bone marrow or the spleen)
  Influence on immune response, etc.
(Procedure)
Subcutaneous tumor growth was measured 3, 5, 7, 10, and 14 days after implantation. Body weights, effects on MSC expansion, and influence on immune response were measured on day 14 in the same way as in Examples described above.

(Results)
As shown in FIG. 119, subcutaneous tumor growth was strongly suppressed by the administration of the anti-FSTL1 antibody, as compared with the control antibody administration group, and tumor disappeared in two out of the five mice. In this model, tumor metastasis to any organ was not macroscopically observed. 14 days after tumor implantation, the mice were too emaciated to walk, as with the bone metastasis models used in the preceding tests, even though at an early stage after tumor implantation. However, weight loss, emaciation, fluffing or the like was not observed in the anti-FSTL1 antibody administration group, and all of the mice were fine.

On the other hand, various immunocytes including MSCs, Tregs, and MDSCs were analyzed as to tumor-infiltrating cells, bone marrow cells, and spleen cells. However, large change was seen in only CD45-ALCAM$^+$ cells which are cancer metastasis-associated sMSCs that became a focus of attention in the bone metastasis models. Although this model was confirmed to cause no bone metastasis, sMSCs increased in number only in bone marrow and decreased in number by the administration of the anti-FSTL1 antibody. 3LL cells were also found to highly express Snail, which presumably incurred sMSC expansion.

These results demonstrated again that FSTL1 inhibitory treatment is effective for cancer types, for example, 3LL cancer, having a common trait, such as "Snail" or "sMSCs". It is expected that lung cancer can also be a cancer type targeted by FSTL1 antibody administration in clinical treatment.

Example 32: Evaluation of In Vivo Drug Efficacy of Each Anti-FSTL1 Antibody Clone In this Example, 4 novel antibody clones confirmed to have effectiveness in the in vitro screening of drug efficacy (#7, #10, #13, and #33) were comparatively evaluated for their in vivo therapeutic effects using, as a positive control, #6-55 used in the preceding tests.
(Material and Method)
Experimental protocol
Experiment group (n=5)
Control IgG (anti-DNP mAb)
6-55
7
10
13
33
1-2. Experimental procedure
Day 0: transplantation of GFP+F10-snail+ tumor cells ($3\times10^5$ cells subcutaneously & $2\times10^4$ cells intravenously)
Day 4: intraperitoneal administration of the antibody (first dose, 10 mg/kg)
Day 7: intraperitoneal administration of the antibody (second dose, 10 mg/kg)
1-3. Index for drug efficacy evaluation
  Suppression of subcutaneous tumor growth
  Extension of mouse survival period
(Procedure)
Subcutaneous tumor was measured 4, 7, 10, 14, 17, 20, and 23 days after tumor cell transplantation.
(Results)
As shown in FIG. 120, all of the clones except for #13 exhibited statistically significant suppressive activity, as with #6-55, against subcutaneous tumor growth, as compared with the control antibody administration group, and no significant difference from #6-55 was seen. On the other hand, as shown in FIG. 121 as to the mouse survival period, all of the clones exhibited a statistically significant life-prolonging effect, as with #6-55, as compared with the control antibody administration group. Particularly, #10 and #33 exhibited therapeutic effects equal to or higher than those of #6-55. For #6-55, statistical significance is indicated at the level of p<0.001 of day 12 even in a test conducted at n=10. Hereinafter, the activity rank of each clone summarized on the basis of P values is shown.
Subcutaneous tumor growth suppressive effect:
7=#10>#6-55>#33>#13
Mouse life-prolonging effect:
33=#10>#6-55>#13>#7

The comprehensive evaluation of these results indicated the possibility that "#10" has high antitumor activity exceeding that of #6-55.

While a wide range of immunocytes, i.e., CD4+ cells, CD8+ cells, and NK cells, participate in antitumor immune response caused by the inhibition of FSTL1, particularly, the CD8+ cells and the NK cells, which exhibit cytotoxic activity, were also confirmed to play an essential role therein (data not shown). In general immunotherapy, antitumor effector cells are typically CD8+ T cells. NK is often regarded as a cell group of low importance that is involved in only the early stage of carcinogenesis. Rather, it has been shown that, for example, therapeutic effects are further enhanced by the removal of CD4+ T cells including Tregs or the like. On the other hand, in the FSTL1 inhibitory treatment of the present invention, various immunocytes including CD8+ cells are recruited to exert an antitumor effect. This is probably because FSTL1 and MSCs amplified by the action of FSTL1 are most upstream key factors in a cancer-associated abnormal immune mechanism, and the inhibition of FSTL1 converted MSCs as well as their various negatively controlled downstream immune responses toward antitumor ones. In other words, the original concept for development was able to be reconfirmed, and the anti-FSTL1 antibody of the present invention differs largely in the mechanism of action from conventional immunomodifying drugs and is expected to be able to serve as a novel therapeutic drug for cancer that can thoroughly improve and appropriately activate the whole host immunity.

Specifically, the inhibition of FSTL1 is presumed to inhibit the differentiation induction of MSCs and inhibit immunosuppressive cell groups (MDSCs and Tregs), thereby activating antitumor immunocyte groups. In this Example, feasibility up to the final stage was confirmed, and it is expected that a suppressor attains effects similar to those generally exhibited by an antibody, by suppressing FSTL1.

Example 33: Characterization of Mouse Chimera

In this Example, the affinity of the produced mouse chimeric antibodies for a human FSTL1 antigen was measured.
(Material and Method)
The mouse chimeric antibodies were immobilized onto Sensor Chip CM5 (GE Healthcare Japan Corp., BR-1005-30) using Mouse Antibody Capture Kit (GE Healthcare Japan Corp., BR-1008-38), and their affinity for human FSTL1 was calculated using Biacore T-200 (GE Healthcare Japan Corp.).
(Results)
First, the exhaustive activity comparison of the obtained antibodies was conducted with the human FSTL1 concentration fixed to 10 μg/ml (Table 33-1, FIG. 122).

The ordinate of FIG. 122 shows the antigen binding amounts of the antibodies. The abscissa shows the antigen dissociation amounts of the antibodies. A higher antigen binding amount and a lower dissociation amount suggest affinity (position closer to the upper left of the figure means higher affinity). Next, the KD values of clone #6-55, #7-34, and #13 presumed to have high affinity in FIG. 122 were calculated with the antigen concentration adjusted to 0 to 20 μg/ml (Table 35-2). As a result, clone #6-55, #7-34, and #13 as well as #7, #10, #33, and the like were also found to have strong affinity in an assay system using surface plasmon resonance.

(Table 33-1) Antigen binding amount and dissociation amount of mouse chimeric antibody

TABLE 4-33-1

| Clone No. | Binding amount (RU) | Dissociation amount (RU) |
|---|---|---|
| #5-2 | 9.2 | 7.1 |
| #5-3 | 11 | 8.8 |
| #5-8 | 6.7 | 3.4 |
| #5-10 | 9.8 | 12.1 |
| #5-43 | 7 | 3.1 |
| #6-55 | 11 | 1.5 |
| #7-34 | 14.2 | 2.5 |
| #8-1 | 11.1 | 12.3 |
| #8-4 | 11.6 | 6.2 |
| #8-7 | 12.8 | 11.8 |
| #8-8 | 8 | 4.7 |
| #7 | 11.9 | 5.4 |
| #10 | 11.7 | 6 |
| #13 | 8.7 | 0.2 |
| #33 | 10.9 | 4.1 |

(Table 33-2) $K_D$ value of mouse chimeric antibody

TABLE 4-33-2

| Clone No. | $K_D$ (M) |
|---|---|
| #6-55 | $2.43 \times 10^*$ |
| #7-34 | $1.22 \times 10^*$ |
| #13 | $1.12 \times 10^*$ |

Example 34: Development and Affinity Measurement of Humanized Antibody

<Affinity of Humanized Antibody: Measurement Using Biacore T-200>

In this Example, humanized antibodies were developed, and the affinity of the developed antibodies for human FSTL1 was measured.
(Material and Method)
Nine IgG1-type humanized antibodies of #6-55 were immobilized onto Sensor Chip CM5 (GE Healthcare Japan Corp., BR-1005-30) using Human Antibody Capture Kit (GE Healthcare Japan Corp., BR-1008-38), and their affinity for human FSTL1 was calculated using Biacore T-200 (GE Healthcare Japan Corp.). The KD values were calculated with the antigen concentration adjusted to 0 to 20 μg/ml (Table 34-1). Among the 9 IgG1-type humanized antibodies of #6-55, a clone composed of a combination "H(2)-L(1)" having a high KD value was selected as a lead antibody.

(Table 34-1) Table. Affinity ($K_D$ value) comparison based on combination of H chain and L chain of humanized 6-55 antibody (IgG1 type)

TABLE 4-34-1 h #6-55

| | H(1)-L(1) | H(1)-L(2) | H(3)-L(1) | H(3)-L(1) | H(2)-L(1) | H(2)-L(2) | H(1)-L(3) | H(2)-L(3) | H(3)-L(3) |
|---|---|---|---|---|---|---|---|---|---|
| KD value (M) | $3.52 \times 10^{-8}$ | $2.50 \times 10^{-8}$ | $2.67 \times 10^{-8}$ | $3.35 \times 10^{-8}$ | $6.05 \times 10^{-8}$ | $1.13 \times 10^{-8}$ | $2.68 \times 10^{-8}$ | $4.50 \times 10^{-8}$ | $2.49 \times 10^{-8}$ |

<Preparation of Humanized Antibody>

On the basis of the report of Matsuda et al., Molecular Immunology 43 (2006) 634-642, a gene was designed such that frame regions present in the H chain and L chain variable regions of clone #6-55 were substituted by human sequences from the chicken sequences. The gene was synthesized. 3 types each of H chains and L chains per clone were designed and synthesized (humanized H chains (1), (2), and (3), and humanized L chains (1), (2), and (3); H chain (1) is also referred to as H(1), H1, etc., and it is understood that all of these terms refer to the same clone; the same holds true for H chain (2), H chain (3), and L chains (1), (2), and (3)). The full-length sequence of the H(1) heavy chain is represented by SEQ ID NOs: 949 and 950 (which represent nucleic acid and amino acid sequences, respectively) for IgG1 type and represented by SEQ ID NOs: 955 and 956 (which represent nucleic acid and amino acid sequences, respectively) for IgG4 type. The full-length sequence of the H(2) heavy chain is represented by SEQ ID NOs: 951 and 952 (which represent nucleic acid and amino acid sequences, respectively) for IgG1 type and represented by SEQ ID NOs: 957 and 958 (which represent nucleic acid and amino acid sequences, respectively) for IgG4 type. The full-length sequence of the H(3) heavy chain is represented by SEQ ID NOs: 953 and 954 (which represent nucleic acid and amino acid sequences, respectively) for IgG1 type and represented by SEQ ID NOs: 959 and 960 (which represent nucleic acid and amino acid sequences, respectively) for IgG4 type. The full-length sequence of the L(1) light chain is represented by SEQ ID NOs: 961 and 962 (which represent nucleic acid and amino acid sequences, respectively). The full-length sequence of the L(2) light chain is represented by SEQ ID NOs: 1003 and 1004 (which represent nucleic acid and amino acid sequences, respectively). The full-length sequence of the L(3) light chain is represented by SEQ ID NOs: 1005 and 1006 (which represent nucleic acid and amino acid sequences, respectively). The synthesized variable region genes were amplified by PCR, then treated with restriction enzymes, and transferred to L chain or H chain expression cassette vectors (restriction enzyme-treated vectors) having gene inserts of a chicken antibody leader sequence and a human IgG1 constant region. HEK293 cells were transfected with 9 types in total of combinations of the constructed H chain (1) to (3) and L chain (1) to (3) expression vectors for the clones, and humanized antibodies were purified from culture supernatants using Protein A Sepharose. As a result of conducting ELISA in order to confirm the binding activity of the purified IgG1-type humanized antibodies against human FSTL1, all of the clones were able to be confirmed to have binding activity to a given extent (FIG. 123). Among them, the humanized clone of H(2)-L(1) exhibited a numerical value higher by an order of magnitude as compared with other clones (see Table 34-1). Therefore, this clone was used in the next experiment.

Binding Activity of Humanized Antibody: ELISA

The binding activity of the purified antibody of IgG1-type humanized #6-55 H chain (2)+L chain (1) against human FSTL1 and mouse FSTL1 was confirmed by ELISA (FIG. 124). From the results of FIG. 124, it was able to be confirmed that the antibody of the present invention has similar binding activity against human FSTL1 and mouse FSTL1 and retains activity against human FSTL1.

Example 35: Effect Brought about by Combined Use with CPA in Subcutaneously Mouse Lung Cancer 3LL-Transplanted Model In this Example, study was conducted using mouse lung cancer 3LL-transplanted models in an experimental system to evaluate effects brought about by combined use of a chemotherapeutic agent and the anti-FSTL1 antibody. An alkylating drug cyclophosphamide (commonly called CPA; "Endoxan for Injection (Shionogi & Co., Ltd.)" was used) was selected from among chemotherapeutic agents whose application to lung cancer has been approved, and used at a dose based on a clinical dose in combination with the anti-FSTL1 antibody. As for an administration timing, the anti-FSTL1 antibody was administered after chemotherapy according to clinical trials of immune checkpoint inhibitors.

1. Experiment group (n=5)
1. Vehicle (0.9% NaCl)+control mouse IgG (anti-DNP)
2. CPA+control mouse IgG
3. Vehicle+anti-FSTL1 mAb (#6-55)
4. CPA+anti-FSTL1 mAb
2. Experiment schedule
Day 0: subcutaneous transplantation of CT26 tumor cells to BALB/c mice (2×105 cells)
Days 4, 5, 6, and 7: intraperitoneal administration of CPA×4 (2 mg/mouse/day)
Days 8 and 11: intraperitoneal administration of the anti-FSTL1 antibody×2 (5 mg/kg half of the usual dose)
Day 20: various immunological assays
3. Results & Discussion The administration of CPA alone strongly suppressed subcutaneous tumor growth and exhibited a significant antitumor effect, as compared with the control antibody administration group. On the other hand, in the anti-FSTL1 antibody administration group, a statistically significant antitumor effect was seen, as compared with the control antibody administration group, though therapeutic effects were low because the anti-FSTL1 antibody was administered at half of the dose used for a single agent as shown in other Examples. When this anti-FSTL1 antibody was used in combination with CPA, an antitumor effect was statistically significantly enhanced, as compared with the single agent treatment, and tumor disappeared in three out of the five mice. Statistical significance was also confirmed even when compared with the CPA single agent treatment. These results indicated their synergistic effects and suggested the possibility that combined use of the anti-FSTL1 antibody with treatment with CPA also clinically produces a higher antitumor effect.

As described above, it was revealed that combined use of a chemotherapeutic agent and a FSTL1 suppressor such as the anti-FSTL1 antibody synergistically enhances an antitumor effect in various aspects. The anti-FSTL1 antibody is expected to provide an effect exceeding an additive effect on the effects of various chemotherapeutic agents.

The present invention is illustrated above by using the preferred embodiments of the present invention. However, it is understood that the scope of the present invention should be interpreted only by claims. It is understood that the contents of patents, patent applications, and literatures cited

INDUSTRIAL APPLICABILITY

The present invention provides prophylactic and therapeutic agent for cancer and techniques of suppressing metastasis, particularly, bone metastasis, by the mitigation of immune defect such as immunosuppression. Particularly, the present invention provides techniques available in industry (reagents, pharmaceutical industry, etc.) involved in techniques related to cancer treatment and prevention, by means of effects brought about by combined use which exerts unexpectedly remarkable effects.

[Free Text of Sequence Listing]

SEQ ID NO: 758: Nucleic acid sequence of human FSTL1
SEQ ID NO: 759: Amino acid sequence of human FSTL1
SEQ ID NO: 760: Nucleic acid sequence of mouse FSTL1
SEQ ID NO: 761: Amino acid sequence of mouse FSTL1
SEQ ID NO: 762: Nucleic acid sequence of the light chain variable region of antibody clone #5-2
SEQ ID NO: 763: Amino acid sequence of the light chain variable region of antibody clone #5-2
SEQ ID NO: 764: Nucleic acid sequence of the heavy chain variable region of antibody clone #5-2
SEQ ID NO: 765: Amino acid sequence of the heavy chain variable region of antibody clone #5-2
SEQ ID NO: 766: Nucleic acid sequence of the light chain variable region of antibody clone #5-3
SEQ ID NO: 767: Amino acid sequence of the light chain variable region of antibody clone #5-3
SEQ ID NO: 768: Nucleic acid sequence of the heavy chain variable region of antibody clone #5-3
SEQ ID NO: 769: Amino acid sequence of the heavy chain variable region of antibody clone #5-3
SEQ ID NO: 770: Nucleic acid sequence of the light chain variable region of antibody clone #5-8
SEQ ID NO: 771: Amino acid sequence of the light chain variable region of antibody clone #5-8
SEQ ID NO: 772: Nucleic acid sequence of the heavy chain variable region of antibody clone #5-8
SEQ ID NO: 773: Amino acid sequence of the heavy chain variable region of antibody clone #5-8
SEQ ID NO: 774: Nucleic acid sequence of the light chain variable region of antibody clone #5-10
SEQ ID NO: 775: Amino acid sequence of the light chain variable region of antibody clone #5-10
SEQ ID NO: 776: Nucleic acid sequence of the heavy chain variable region of antibody clone #5-10
SEQ ID NO: 777: Amino acid sequence of the heavy chain variable region of antibody clone #5-10
SEQ ID NO: 778: Nucleic acid sequence of the light chain variable region of antibody clone #5-43
SEQ ID NO: 779: Amino acid sequence of the light chain variable region of antibody clone #5-43
SEQ ID NO: 780: Nucleic acid sequence of the heavy chain variable region of antibody clone #5-43
SEQ ID NO: 781: Amino acid sequence of the heavy chain variable region of antibody clone #5-43
SEQ ID NO: 782: Nucleic acid sequence of the light chain variable region of antibody clone #6-55
SEQ ID NO: 783: Amino acid sequence of the light chain variable region of antibody clone #6-55
SEQ ID NO: 784: Nucleic acid sequence of the heavy chain variable region of antibody clone #6-55
SEQ ID NO: 785: Amino acid sequence of the heavy chain variable region of antibody clone #6-55
SEQ ID NO: 786: Nucleic acid sequence of the light chain variable region of antibody clone #7-34
SEQ ID NO: 787: Amino acid sequence of the light chain variable region of antibody clone #7-34
SEQ ID NO: 788: Nucleic acid sequence of the heavy chain variable region of antibody clone #7-34
SEQ ID NO: 789: Amino acid sequence of the heavy chain variable region of antibody clone #7-34
SEQ ID NO: 790: Nucleic acid sequence of the light chain variable region of antibody clone #8-1
SEQ ID NO: 791: Amino acid sequence of the light chain variable region of antibody clone #8-1
SEQ ID NO: 792: Nucleic acid sequence of the heavy chain variable region of antibody clone #8-1
SEQ ID NO: 793: Amino acid sequence of the heavy chain variable region of antibody clone #8-1
SEQ ID NO: 794: Nucleic acid sequence of the light chain variable region of antibody clone #8-4
SEQ ID NO: 795: Amino acid sequence of the light chain variable region of antibody clone #8-4
SEQ ID NO: 796: Nucleic acid sequence of the heavy chain variable region of antibody clone #8-4
SEQ ID NO: 797: Amino acid sequence of the heavy chain variable region of antibody clone #8-4
SEQ ID NO: 798: Nucleic acid sequence of the light chain variable region of antibody clone #8-7
SEQ ID NO: 799: Amino acid sequence of the light chain variable region of antibody clone #8-7
SEQ ID NO: 800: Nucleic acid sequence of the heavy chain variable region of antibody clone #8-7
SEQ ID NO: 801: Amino acid sequence of the heavy chain variable region of antibody clone #8-7
SEQ ID NO: 802: Nucleic acid sequence of the light chain variable region of antibody clone #8-8
SEQ ID NO: 803: Amino acid sequence of the light chain variable region of antibody clone #8-8
SEQ ID NO: 804: Nucleic acid sequence of the heavy chain variable region of antibody clone #8-8
SEQ ID NO: 805: Amino acid sequence of the heavy chain variable region of antibody clone #8-8
SEQ ID NO: 806: Nucleic acid sequence of the light chain variable region of antibody clone #7
SEQ ID NO: 807: Amino acid sequence of the light chain variable region of antibody clone #7
SEQ ID NO: 808: Nucleic acid sequence of the heavy chain variable region of antibody clone #7
SEQ ID NO: 809: Amino acid sequence of the heavy chain variable region of antibody clone #7
SEQ ID NO: 810: Nucleic acid sequence of the light chain variable region of antibody clone #10
SEQ ID NO: 811: Amino acid sequence of the light chain variable region of antibody clone #10
SEQ ID NO: 812: Nucleic acid sequence of the heavy chain variable region of antibody clone #10
SEQ ID NO: 813: Amino acid sequence of the heavy chain variable region of antibody clone #10
SEQ ID NO: 814: Nucleic acid sequence of the light chain variable region of antibody clone #13
SEQ ID NO: 815: Amino acid sequence of the light chain variable region of antibody clone #13
SEQ ID NO: 816: Nucleic acid sequence of the heavy chain variable region of antibody clone #13
SEQ ID NO: 817: Amino acid sequence of the heavy chain variable region of antibody clone #13

SEQ ID NO: 818: Nucleic acid sequence of the light chain variable region of antibody clone #22
SEQ ID NO: 819: Amino acid sequence of the light chain variable region of antibody clone #22
SEQ ID NO: 820: Nucleic acid sequence of the heavy chain variable region of antibody clone #22
SEQ ID NO: 821: Amino acid sequence of the heavy chain variable region of antibody clone #22
SEQ ID NO: 822: Nucleic acid sequence of the light chain variable region of antibody clone #33
SEQ ID NO: 823: Amino acid sequence of the light chain variable region of antibody clone #33
SEQ ID NO: 824: Nucleic acid sequence of the heavy chain variable region of antibody clone #33
SEQ ID NO: 825: Amino acid sequence of the heavy chain variable region of antibody clone #33
SEQ ID NO: 826: Nucleic acid sequence of FSTL1 used in Examples (human; human FSTL1 gene after codon optimization+sequence with sequences for recombination added at both ends+C-terminally 3×alanine+6×histidine-added sequence)
SEQ ID NO: 827: Amino acid sequence of FSTL1 used in Examples (human; human FSTL1 gene after codon optimization+sequence with sequences for recombination added at both ends+C-terminally 3×alanine+6×histidine-added sequence)
SEQ ID NO: 828: Nucleic acid sequence of FSTL1 used in Examples (mouse; mouse FSTL1 gene after codon optimization+sequence with sequences for recombination added at both ends+C-terminally 3×alanine+6×histidine-added sequence)
SEQ ID NO: 829: Amino acid sequence of FSTL1 used in Examples (mouse; mouse FSTL1 gene after codon optimization+sequence with sequences for recombination (red) added at both ends+C-terminally 3×alanine+6×histidine-added sequence)
SEQ ID NO: 830: MCS sequence
SEQ ID NO: 831: MCS sequence (complementary chain)
SEQ ID NO: 832: Sequence for insertion
SEQ ID NO: 833: Sequence for insertion
SEQ ID NO: 834: Δ21-53 (Forward primer)
SEQ ID NO: 835: Δ21-53 (Reverseprimer)
SEQ ID NO: 836: Δ100-140 (Forward primer)
SEQ ID NO: 837: Δ100-140 (Reverseprimer)
SEQ ID NO: 838: Δ148-170 (Forward primer)
SEQ ID NO: 839: Δ148-170 (Reverseprimer)
SEQ ID NO: 840: Δ181-190 (Forward primer)
SEQ ID NO: 841: Δ181-190 (Reverseprimer)
SEQ ID NO: 842: Δ193-228 (Forward primer)
SEQ ID NO: 843: Δ193-228 (Reverseprimer)
SEQ ID NO: 844: Δ233-289 (Forward primer)
SEQ ID NO: 845: Δ233-289 (Reverseprimer)
SEQ ID NO: 846: Δ148-154 (Forward primer)
SEQ ID NO: 847: Δ148-154 (Reverse primer)
SEQ ID NO: 848: Δ155-162 (Forward primer)
SEQ ID NO: 849: Δ155-162 (Reverse primer)
SEQ ID NO: 850: Δ163-170 (Forward primer)
SEQ ID NO: 851: Δ163-170 (Reverse primer)
SEQ ID NO: 852: Full-length nucleic acid sequence of the light chain of antibody clone #5-2
SEQ ID NO: 853: Full-length amino acid sequence of the light chain of antibody clone #5-2
SEQ ID NO: 854: Full-length nucleic acid sequence of the heavy chain of antibody clone #5-2
SEQ ID NO: 855: Full-length amino acid sequence of the heavy chain of antibody clone #5-2
SEQ ID NO: 856: Full-length nucleic acid sequence of the light chain of antibody clone #5-3
SEQ ID NO: 857: Full-length amino acid sequence of the light chain of antibody clone #5-3
SEQ ID NO: 858: Full-length nucleic acid sequence of the heavy chain of antibody clone #5-3
SEQ ID NO: 859: Full-length amino acid sequence of the heavy chain of antibody clone #5-3
SEQ ID NO: 860: Full-length nucleic acid sequence of the light chain of antibody clone #5-8
SEQ ID NO: 861: Full-length amino acid sequence of the light chain of antibody clone #5-8
SEQ ID NO: 862: Full-length nucleic acid sequence of the heavy chain of antibody clone #5-8
SEQ ID NO: 863: Full-length amino acid sequence of the heavy chain of antibody clone #5-8
SEQ ID NO: 864: Full-length nucleic acid sequence of the light chain of antibody clone #5-10
SEQ ID NO: 865: Full-length amino acid sequence of the light chain of antibody clone #5-10
SEQ ID NO: 866: Full-length nucleic acid sequence of the heavy chain of antibody clone #5-10
SEQ ID NO: 867: Full-length amino acid sequence of the heavy chain of antibody clone #5-10
SEQ ID NO: 868: Full-length nucleic acid sequence of the light chain of antibody clone #5-43
SEQ ID NO: 869: Full-length amino acid sequence of the light chain of antibody clone #5-43
SEQ ID NO: 870: Full-length nucleic acid sequence of the heavy chain of antibody clone #5-43
SEQ ID NO: 871: Full-length amino acid sequence of the heavy chain of antibody clone #5-43
SEQ ID NO: 872: Full-length nucleic acid sequence of the light chain of antibody clone #6-55
SEQ ID NO: 873: Full-length amino acid sequence of the light chain of antibody clone #6-55
SEQ ID NO: 874: Full-length nucleic acid sequence of antibody clone #6-55
SEQ ID NO: 875: Full-length amino acid sequence of antibody clone #6-55
SEQ ID NO: 876: Full-length nucleic acid sequence of the light chain of antibody clone #7-34
SEQ ID NO: 877: Full-length amino acid sequence of the light chain of antibody clone #7-34
SEQ ID NO: 878: Full-length nucleic acid sequence of the heavy chain of antibody clone #7-34
SEQ ID NO: 879: Full-length amino acid sequence of the heavy chain of antibody clone #7-34
SEQ ID NO: 880: Full-length nucleic acid sequence of the light chain of antibody clone #8-1
SEQ ID NO: 881: Full-length amino acid sequence of the light chain of antibody clone #8-1
SEQ ID NO: 882: Full-length nucleic acid sequence of the heavy chain of antibody clone #8-1
SEQ ID NO: 883: Full-length amino acid sequence of the heavy chain of antibody clone #8-1
SEQ ID NO: 884: Full-length nucleic acid sequence of the light chain of antibody clone #8-4
SEQ ID NO: 885: Full-length amino acid sequence of the light chain of antibody clone #8-4
SEQ ID NO: 886: Full-length nucleic acid sequence of the heavy chain of antibody clone #8-4
SEQ ID NO: 887: Full-length amino acid sequence of the heavy chain of antibody clone #8-4
SEQ ID NO: 888: Full-length nucleic acid sequence of the light chain of antibody clone #8-7

SEQ ID NO: 889: Full-length amino acid sequence of the light chain of antibody clone #8-7
SEQ ID NO: 890: Full-length nucleic acid sequence of the heavy chain of antibody clone #8-7
SEQ ID NO: 891: Full-length amino acid sequence of the heavy chain of antibody clone #8-7
SEQ ID NO: 892: Full-length nucleic acid sequence of the light chain of antibody clone #8-8
SEQ ID NO: 893: Full-length amino acid sequence of the light chain of antibody clone #8-8
SEQ ID NO: 894: Full-length nucleic acid sequence of the heavy chain of antibody clone #8-8
SEQ ID NO: 895: Full-length amino acid sequence of the heavy chain of antibody clone #8-8
SEQ ID NO: 896: Full-length nucleic acid sequence of the light chain of antibody clone #7
SEQ ID NO: 897: Full-length amino acid sequence of the light chain of antibody clone #7
SEQ ID NO: 898: Full-length nucleic acid sequence of the heavy chain of antibody clone #7
SEQ ID NO: 899: Full-length amino acid sequence of the heavy chain of antibody clone #7
SEQ ID NO: 900: Full-length nucleic acid sequence of the light chain of antibody clone #10
SEQ ID NO: 901: Full-length amino acid sequence of the light chain of antibody clone #10
SEQ ID NO: 902: Full-length nucleic acid sequence of the heavy chain of antibody clone #10
SEQ ID NO: 903: Full-length amino acid sequence of the heavy chain of antibody clone #10
SEQ ID NO: 904: Full-length nucleic acid sequence of the light chain of antibody clone #13
SEQ ID NO: 905: Full-length amino acid sequence of the light chain of antibody clone #13
SEQ ID NO: 906: Full-length nucleic acid sequence of the heavy chain of antibody clone #13
SEQ ID NO: 907: Full-length amino acid sequence of the heavy chain of antibody clone #13
SEQ ID NO: 908: Full-length nucleic acid sequence of the light chain of antibody clone #22
SEQ ID NO: 909: Full-length amino acid sequence of the light chain of antibody clone #22
SEQ ID NO: 910: Full-length nucleic acid sequence of the heavy chain of antibody clone #22
SEQ ID NO: 911: Full-length amino acid sequence of the heavy chain of antibody clone #22
SEQ ID NO: 912: Full-length nucleic acid sequence of the light chain of antibody clone #33
SEQ ID NO: 913: Full-length amino acid sequence of the light chain of antibody clone #33
SEQ ID NO: 914: Full-length nucleic acid sequence of the heavy chain of antibody clone #33
SEQ ID NO: 915: Full-length amino acid sequence of the heavy chain of antibody clone #33
SEQ ID NO: 916: Amino acid sequence of FSTL1 of Novoprotein
SEQ ID NO: 917: Nucleic acid sequence of framework 1 of the H(1) heavy chain of a humanized sequence
SEQ ID NO: 918: Amino acid sequence of framework 1 of the H(1) heavy chain of the humanized sequence
SEQ ID NO: 919: Nucleic acid sequence of framework 2 of the H(1) heavy chain of the humanized sequence
SEQ ID NO: 920: Amino acid sequence of framework 2 of the H(1) heavy chain of the humanized sequence
SEQ ID NO: 921: Nucleic acid sequence of framework 3 of the H(1) heavy chain of the humanized sequence
SEQ ID NO: 922: Amino acid sequence of framework 3 of the H(1) heavy chain of the humanized sequence
SEQ ID NO: 923: Nucleic acid sequence of framework 4 of the H(1) heavy chain of the humanized sequence
SEQ ID NO: 924: Amino acid sequence of framework 4 of the H(1) heavy chain of the humanized sequence
SEQ ID NO: 925: Nucleic acid sequence of framework 1 of the H(2) heavy chain of a humanized sequence
SEQ ID NO: 926: Amino acid sequence of framework 1 of the H(2) heavy chain of the humanized sequence
SEQ ID NO: 927: Nucleic acid sequence of framework 2 of the H(2) heavy chain of the humanized sequence
SEQ ID NO: 928: Amino acid sequence of framework 2 of the H(2) heavy chain of the humanized sequence
SEQ ID NO: 929: Nucleic acid sequence of framework 3 of the H(2) heavy chain of the humanized sequence
SEQ ID NO: 930: Amino acid sequence of framework 3 of the H(2) heavy chain of the humanized sequence
SEQ ID NO: 931: Nucleic acid sequence of framework 4 of the H(2) heavy chain of the humanized sequence
SEQ ID NO: 932: Amino acid sequence of framework 4 of the H(2) heavy chain of the humanized sequence
SEQ ID NO: 933: Nucleic acid sequence of framework 1 of the H(3) heavy chain of a humanized sequence
SEQ ID NO: 934: Amino acid sequence of framework 1 of the H(3) heavy chain of the humanized sequence
SEQ ID NO: 935: Nucleic acid sequence of framework 2 of the H(3) heavy chain of the humanized sequence
SEQ ID NO: 936: Amino acid sequence of framework 2 of the H(3) heavy chain of the humanized sequence
SEQ ID NO: 937: Nucleic acid sequence of framework 3 of the H(3) heavy chain of the humanized sequence
SEQ ID NO: 938: Amino acid sequence of framework 3 of the H(3) heavy chain of the humanized sequence
SEQ ID NO: 939: Nucleic acid sequence of framework 4 of the H(3) heavy chain of the humanized sequence
SEQ ID NO: 940: Amino acid sequence of framework 4 of the H(3) heavy chain of the humanized sequence
SEQ ID NO: 941: Nucleic acid sequence of framework 1 of the L(1) light chain of a humanized sequence
SEQ ID NO: 942: Amino acid sequence of framework 1 of the L(1) light chain of the humanized sequence
SEQ ID NO: 943: Nucleic acid sequence of framework 2 of the L(1) light chain of the humanized sequence
SEQ ID NO: 944: Amino acid sequence of framework 2 of the L(1) light chain of the humanized sequence
SEQ ID NO: 945: Nucleic acid sequence of framework 3 of the L(1) light chain of the humanized sequence
SEQ ID NO: 946: Amino acid sequence of framework 3 of the L(1) light chain of the humanized sequence
SEQ ID NO: 947: Nucleic acid sequence of framework 4 of the L(1) light chain of the humanized sequence
SEQ ID NO: 948: Amino acid sequence of framework 4 of the L(1) light chain of the humanized sequence
SEQ ID NO: 949: Full-length nucleic acid sequence of the IgG1-type H(1) heavy chain of a humanized sequence
SEQ ID NO: 950: Full-length amino acid sequence of the IgG1-type H(1) heavy chain of the humanized sequence
SEQ ID NO: 951: Full-length nucleic acid sequence of the IgG1-type H(2) heavy chain of a humanized sequence
SEQ ID NO: 952: Full-length amino acid sequence of the IgG1-type H(2) heavy chain of the humanized sequence
SEQ ID NO: 953: Full-length nucleic acid sequence of the IgG1-type H(3) heavy chain of a humanized sequence
SEQ ID NO: 954: Full-length amino acid sequence of the IgG1-type H(3) heavy chain of the humanized sequence SEQ ID NO: 955: Full-length nucleic acid sequence of the IgG4-type H(1) heavy chain of a humanized sequence
SEQ ID NO: 956: Full-length amino acid sequence of the IgG4-type H(1) heavy chain of the humanized sequence
SEQ ID NO: 957: Full-length nucleic acid sequence of the IgG4 H(2) heavy chain of a humanized sequence
SEQ ID NO: 958: Full-length amino acid sequence of the IgG4 H(2) heavy chain of the humanized sequence
SEQ ID NO: 959: Full-length nucleic acid sequence of the IgG4 H(3) heavy chain of a humanized sequence
SEQ ID NO: 960: Full-length amino acid sequence of the IgG4 H(3) heavy chain of the humanized sequence
SEQ ID NO: 961: Full-length nucleic acid sequence of the L(1) light chain of a humanized sequence
SEQ ID NO: 962: Full-length amino acid sequence of the L(1) light chain of a humanized sequence
SEQ ID NO: 963: Amino acid sequence of heavy chain sequence framework 1 of a chicken sequence for reference
SEQ ID NO: 964: Amino acid sequence of heavy chain sequence framework 2 of the chicken sequence for reference
SEQ ID NO: 965: Amino acid sequence of heavy chain sequence framework 3 of the chicken sequence for reference
SEQ ID NO: 966: Amino acid sequence of heavy chain sequence framework 4 of the chicken sequence for reference
SEQ ID NO: 967: Amino acid sequence of light chain sequence framework 1 of the chicken sequence for reference
SEQ ID NO: 968: Amino acid sequence of light chain sequence framework 2 of the chicken sequence for reference
SEQ ID NO: 969: Amino acid sequence of light chain sequence framework 3 of the chicken sequence for reference
SEQ ID NO: 970: Amino acid sequence of light chain sequence framework 4 of the chicken sequence for reference
SEQ ID NO: 971: Alternative amino acid sequence of light chain sequence framework 2 of the chicken sequence for reference
SEQ ID NO: 972: Alternative amino acid sequence of light chain sequence framework 3 of the chicken sequence for reference
SEQ ID NO: 973: Δ193-204 (Forward primer)
SEQ ID NO: 974: Δ193-204 (Reverse primer)
SEQ ID NO: 975: Δ205-216 (Forward primer)
SEQ ID NO: 976: Δ205-216 (Reverse primer)
SEQ ID NO: 977: Δ217-228 (Forward primer)
SEQ ID NO: 978: Δ217-228 (Reverse primer)
SEQ ID NO: 979: Δ233-251 (Forward primer)
SEQ ID NO: 980: Δ233-251 (Reverse primer)
SEQ ID NO: 981: Δ252-270 (Forward primer)
SEQ ID NO: 982: Δ252-270 (Reverse primer)
SEQ ID NO: 983: Δ271-289 (Forward primer)
SEQ ID NO: 984: Δ271-289 (Reverse primer)
SEQ ID NO: 985: Δ48-100 (Forward primer)
SEQ ID NO: 986: Δ48-100 (Reverse primer)
SEQ ID NO: 987: Nucleic acid sequence of framework 1 of the L(2) light chain of a humanized sequence
SEQ ID NO: 988: Amino acid sequence of framework 1 of the L(2) light chain of the humanized sequence
SEQ ID NO: 989: Nucleic acid sequence of framework 2 of the L(2) light chain of the humanized sequence
SEQ ID NO: 990: Amino acid sequence of framework 2 of the L(2) light chain of the humanized sequence
SEQ ID NO: 991: Nucleic acid sequence of framework 3 of the L(2) light chain of the humanized sequence
SEQ ID NO: 992: Amino acid sequence of framework 3 of the L(2) light chain of the humanized sequence
SEQ ID NO: 993: Nucleic acid sequence of framework 4 of the L(2) light chain of the humanized sequence
SEQ ID NO: 994: Amino acid sequence of framework 4 of the L(2) light chain of the humanized sequence
SEQ ID NO: 995: Nucleic acid sequence of framework 1 of the L(3) light chain of humanized sequence
SEQ ID NO: 996: Amino acid sequence of framework 1 of the L(3) light chain of humanized sequence
SEQ ID NO: 997: Nucleic acid sequence of framework 2 of the L(3) light chain of humanized sequence
SEQ ID NO: 998: Amino acid sequence of framework 2 of the L(3) light chain of humanized sequence
SEQ ID NO: 999: Nucleic acid sequence of framework 3 of the L(3) light chain of humanized sequence
SEQ ID NO: 1000: Amino acid sequence of framework 3 of the L(3) light chain of humanized sequence
SEQ ID NO: 1001: Nucleic acid sequence of framework 4 of the L(3) light chain of humanized sequence
SEQ ID NO: 1002: Amino acid sequence of framework 4 of the L(3) light chain of humanized sequence
SEQ ID NO: 1003: Full-length nucleic acid sequence of the L(2) light chain of the humanized sequence
SEQ ID NO: 1004: Full-length amino acid sequence of the L(2) light chain of the humanized sequence
SEQ ID NO: 1005: Full-length nucleic acid sequence of the L(3) light chain of the humanized sequence
SEQ ID NO: 1006: Full-length amino acid sequence of the L(3) light chain of the humanized sequence <Part 5>

The present invention further provides the following:

(123) An anti-FSTL1 antibody or a fragment or functional equivalent thereof, wherein the antibody recognizes an epitope of one or more amino acids contained in a region selected from the group consisting of amino acid positions 48 to 100, 148 to 162, 193 to 216, 205 to 228, and 272 to 289 of SEQ ID NO: 1 (amino acid sequence of human FSTL1).

(124) A combination product of a FSTL1 suppressor and additional cancer treatment.

(125) The combination product according to item 124, wherein the additional cancer treatment is at least one selected from cancer immunotherapy, molecular targeting therapy, and chemotherapy.

(126) The combination product according to item 125, wherein the cancer immunotherapy is at least one selected from administration of a drug for mitigation of immunosuppression, administration of a cancer vaccine, and immune cell therapy.

(127) The combination product according to item 126, wherein the drug for mitigation of immunosuppression is at least one selected from a PD-L1 suppressor, a CTLA4 suppressor, a PD-1 suppressor, a 4-1BB suppressor, a 4-1BB promoter, a OX40 promoter, a GITR suppressor, a CD27 suppressor, a CD40 promoter, a LAGS suppressor, a B7-H3 suppressor, a KIRs suppressor, a NKG2A suppressor, a CSF1R suppressor, an IDO suppressor, a TGFβ suppressor, a CXCR4 suppressor, a phosphatidylserine suppressor, a CD47 suppressor, a VEGF suppressor, and neuropilin suppressor.

(128) The combination product according to item 126, wherein the immune cell therapy is at least one selected from chimeric antigen receptor expression T cell therapy, dendritic cell therapy, and activated lymphocyte therapy.

(129) The combination product according to item 125, wherein a molecular targeting drug for use in the molecular targeting therapy is at least one selected from an anti-CD20 antibody, an anti-HER2 antibody, an anti-HER3 antibody, an anti-EGFR antibody, an anti-VEGF antibody, an anti-CD33 antibody (calicheamicin-conjugated), an anti-CD52 antibody, an anti-CD19/CD3 antibody, an anti-RANKL antibody, an anti-CD30 antibody, an anti-CCR4 antibody, an anti-folate receptor antibody, an anti-glypican antibody, an anti-CD26 antibody, an anti-IGF antibody, an anti-B7-H3 antibody, an anti-EPHA antibody, an anti-IGFR1 antibody, an anti-GD2 (ganglioside) antibody, an anti-EDb (fibronectin) antibody, an anti-CS1 antibody, an anti-VEGFR-2 antibody, an anti-CD4 antibody, an anti-Met antibody, an anti-CD22 antibody, an anti-G250 antibody, an anti-integrin (CD51) antibody, an anti-integrin av antibody, an anti-hepatocyte growth factor/scatter factor antibody, an anti-PDGFRa antibody, an anti-HGF (hepatocyto growth factor) antibody, an anti-PLGF (placental growth factor) antibody, an anti-c-Met antibody, an anti-myostatin antibody, an anti-EpCAM (CD326) antibody, an anti-EGFL7 (epidermal growth factor domain-like 7) antibody, an anti-EGFR/HER3 bispecific antibody, an anti-LOXL2 (lysyl oxidase-like-2) antibody, an anti-TRAIL R1 antibody, an anti-CD56 antibody, an anti-CD22 antibody, an anti-IL-6 antibody, an anti-GD3 antibody, an anti-FAP (fibroblast activation protein) antibody, an anti-CD221 (insulin-like growth factor 1 receptor) antibody, an anti-CD19/T cell bispecific antibody, an anti-DKK-1 (Dickkopf-1) antibody, an anti-DNA histone complex antibody, an anti-phosphatidyl serine antibody, an anti-angiopoietin-2 antibody, an anti-RI (131I) antibody, an anti-IL-2 antibody, an anti-TNF-α antibody, an anti-CD105 antibody, an anti-IL-1α antibody, an anti-PSCA antibody, an anti-mesothelin antibody, an anti-TEM-1 antibody, an anti-GPNMB antibody, an anti-DR5 antibody, an anti-TF-VIIa antibody, an anti-CD200 (OX-2) antibody, an anti-CD138 antibody, an anti-CD20/CD3 bispecific antibody, an anti-IL-13 antibody, an anti-CD38 antibody, an anti-hPAM4 antibody, an anti-CD74 antibody, an anti-MUC5AC antibody, and an anti-CD40 antibody.

(130) The combination product according to item 125, wherein a chemotherapeutic agent for use in the chemotherapy is at least one selected from the group consisting of an alkylating agent, a nitrosourea agent, an antimetabolite, an anticancer antibiotic, a plant-derived alkaloid, a topoisomerase inhibitor, a hormone therapeutic agent, a hormone antagonist, an aromatase inhibitor, a P glycoprotein inhibitor, and a platinum complex derivative.

(131) The combination product according to item 124, wherein the FSTL1 suppressor is selected from the group consisting of an antibody, an antigen binding fragment thereof, a derivative of the antibody or the fragment, a functional equivalent, an antisense nucleic acid, siRNA, an aptamer, and a ribozyme, and a complex thereof.

(132) The combination product according to item 124, wherein the FSTL1 suppressor is an anti-FSTL1 antibody or a fragment or functional equivalent thereof.

(133) The combination product according to item 132, wherein the anti-FSTL1 antibody or the fragment or functional equivalent thereof is an anti-FSTL1 antibody or a fragment or functional equivalent thereof according to any of items A1 to A18 of PART 1.

(134) A medicament comprising a combination product according to any one of items 124 to 133.

(135) An anticancer agent comprising a combination product according to any one of items 124 to 133.

(136) A therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, head and neck cancer, pancreatic cancer, bladder cancer, uterine cervical cancer, brain central nervous system tumor, sarcoma, leukemia, and multiple myeloma, comprising a combination product according to any one of items 124 to 133.

(137) A therapeutic agent for lung cancer, comprising a combination product according to any one of items 124 to 133.

(138) An inhibitor of metastasis of cancer cells, comprising a combination product according to any one of items 124 to 133.

(139) An inhibitor of enhancement of immune defect by mesenchymal stem cells (MSCs), comprising a combination product according to any one of items 124 to 133.

(140) The inhibitor according to item 139, wherein the immune defect includes immunosuppression and immunodeficiency.

(141) The inhibitor according to item 139, wherein the enhancement of immune defect includes at least one of growth of MSC cells having immunosuppressive activity or immunodeficient activity, enhancement of the immunosuppressive activity or immunodeficient activity of MSC cells having immune activity or anti-immunodeficiency activity, and acquirement of immunosuppressive activity or immunodeficient activity by MSC cells lacking immunosuppressive activity or immunodeficient activity.

(142) An inhibitor of acquirement and/or enhancement of immune defect activity by or of immune-related cells, comprising a combination product according to any one of items 124 to 133.

(143) The inhibitor according to item 142, wherein the immune defect includes immunosuppression and immunodeficiency.

(144) The inhibitor according to item 142, wherein the acquirement and/or enhancement of immune defect activity by or of immune-related cells includes at least one selected from the group consisting of growth of regulatory T cells, enhancement of the immunosuppressive activity of regulatory T cells, differentiation into regulatory T cells, growth of regulatory dendritic cells, enhancement of the immunosuppressive activity of regulatory dendritic cells, differentiation into regulatory dendritic cells, growth of tolerogenic dendritic cells, enhancement of the immunosuppressive activity of tolerogenic dendritic cells, differentiation into tolerogenic dendritic cells, growth of myeloid-derived suppressor cells, enhancement of the immunosuppressive activity of myeloid-derived suppressor cells, differentiation into myeloid-derived suppressor cells, growth of exhausted T cells, enhancement of the immunodeficient activity of exhausted T cells, and induction of exhausted T cells.

(145) An anti-FSTL1 antibody or a fragment or functional equivalent thereof, wherein a full-length heavy chain has the amino acid sequence of SEQ ID NO: 1008, and a full-length light chain has the amino acid sequence of SEQ ID NO: 1010.

In the combination product of a FSTL1 suppressor and additional cancer treatment of the present invention, the additional cancer treatment is not particularly limited and can be any treatment as long as the treatment targets cancer. At least one selected from cancer immunotherapy, molecular targeting therapy, and chemotherapy is preferred. The cancer immunotherapy is not particularly limited and is preferably at least one selected from administration of a drug for mitigation of immunosuppression, administration of a cancer vaccine, and immune cell therapy.

A publicly known drug for mitigation of immunosuppression or a drug for mitigation of immunosuppression that will be developed in the future can be suitably used as the drug for mitigation of immunosuppression. At least one selected from, for example, a PD-L1 suppressor, a CTLA4 suppressor, a PD-1 suppressor, a 4-1BB suppressor, a 4-1BB promoter, an OX40 promoter, a GITR suppressor, a CD27 suppressor, a CD40 promoter, a LAG3 suppressor, a B7-H3 suppressor, a KIRs suppressor, a NKG2A suppressor, a CSF1R suppressor, an IDO suppressor, a TGFβ suppressor, a CXCR4 suppressor, a phosphatidylserine suppressor, a CD47 suppressor, a VEGF suppressor, and a neuropilin suppressor is preferred. A PD-L1 suppressor or a CTLA4 suppressor is more preferred.

Examples of the PD-L1 suppressor include an anti-PD-L1 antibody. Examples thereof include atezolizumab, MEDI4736, and avelumab. Examples of the CTLA4 suppressor include an anti-CTLA4 antibody. Examples thereof include ipilimumab and tremelimumab. Examples of the PD-1 suppressor include an anti-PD-1 antibody. Examples thereof include pembrolizumab, nivolumab, and PDR001. Examples of the 4-1BB suppressor include an anti-4-1BB antibody. Examples thereof include urelumab. Examples of the 4-1BB promoter include a 4-1BB agonistic antibody. Examples thereof include PF-05082566. Examples of the OX40 promoter include an OX40 agonistic antibody. Examples thereof include MEDI6469. Examples of the GITR suppressor include an anti-GITR antibody. Examples thereof include TRX518. Examples of the CD27 suppressor include an anti-CD27 antibody. Examples thereof include varlilumab. Examples of the CD40 promoter include a CD40 agonistic antibody. Examples thereof include CP-870893. Examples of the LAG3 suppressor include an anti-LAG3 antibody. Examples thereof include BMS-986016. Examples of the B7-H3 suppressor include an anti-B7-H3 antibody. Examples thereof include enoblituzumab. Examples of the KIRs suppressor include an anti-KIRs antibody. Examples thereof include lirilumab. Examples of the NKG2A suppressor include an anti-NKG2A antibody. Examples thereof include IPH2201. Examples of the CSF1R suppressor include an anti-CSF1R antibody. Examples thereof include emactuzumab. Examples of the IDO suppressor include an IDO inhibitor. Examples thereof include INCB024360. Examples of the TGFβ suppressor include a TGFβ inhibitor. Examples thereof include galunisertib. Examples of the CXCR4 suppressor include an anti-CXCR4 antibody. Examples thereof include ulocuplumab. Examples of the CXCR4 suppressor include a CXCR4 inhibitor. Examples thereof include BKT140. Examples of the phosphatidylserine suppressor include an anti-phosphatidylserine antibody. Examples thereof include bavituximab. Examples of the CD47 suppressor include an anti-CD47 antibody. Examples thereof include CC-90002. Examples of the VEGF suppressor include an anti-VEGF antibody. Examples thereof include bevacizumab. Examples of the neuropilin suppressor include an anti-neuropilin antibody. Examples thereof include MNRP1685A (reference: Kathleen M. Mahoney, Paul D. Rennert and Gordon J. Freeman, "Combination cancer immunotherapy and new immunomodulatory targets" NATURE REVIEWS DRUG DISCOVERY, VOLUME 14, 2015: 561-584).

A publicly known cancer vaccine or a cancer vaccine that will be developed in the future can be suitably used as the cancer vaccine. Examples thereof include Provenge (trade name), OncoVAX (trade name), DCVax-L (trade name), Stimuvax (trade name), HyperAcute (trade name), Prostvac-V/F-(trade name), TRICOM (trade name), ProstAtak (trade name), Lucanix (trade name), Sipuleucel T, GVAX, Theratope, Tecemotide, L-BLP25, GSK1572932A, Belagenpumatucel L, GSK 2132231A, GV1001, Gp100, AGS-003, Algenpantucel-L, Tergenpantucel-L, TG4010, MVA-MUC1-IL2, Rindopepimut, CDX-110, E75 peptide acetate, NeuVax, M-Vax, CimaVax-EGF, IMA901, POL-103A, pumatucel-L, MDX-1379, OCV-101, S-588410, WT4869, WT2725, WT4869, OCV-02, ONO-7268MX1, ONO-7268MX2.

The immune cell therapy used as the cancer immunotherapy is not particularly limited and is preferably at least one selected from chimeric antigen receptor expression T cell therapy, dendritic cell therapy, and activated lymphocyte therapy. Examples of the chimeric antigen receptor expression T cell therapy include anti-CD19 CART cell therapy. Examples of agents suitably used in the dendritic cell therapy and the activated lymphocyte therapy include Provenge (trade name), OncoVAX (trade name), DCVax-L (trade name), HyperAcute (trade name), Lucanix (trade name), GVAX, AGS-003, and M-Vax.

A publicly known molecular targeting drug or a molecular targeting drug that will be developed in the future can be suitably used in the molecular targeting therapy. At least one selected from, for example, an anti-CD20 antibody, an anti-HER2 antibody, an anti-HER3 antibody, an anti-EGFR antibody, an anti-VEGF antibody, an anti-CD33 antibody, an anti-CD52 antibody, an anti-CD19/CD3 antibody, an anti-RANKL antibody, an anti-CD30 antibody, an anti-CCR4 antibody, an anti-folate receptor antibody, an anti-glypican antibody, an anti-CD26 antibody, an anti-IGF antibody, an anti-B7-H3 antibody, an anti-EPHA antibody, an anti-IGFR1 antibody, an anti-GD2 (ganglioside) antibody, an anti-EDb (fibronectin) antibody, an anti-CS1 antibody, an anti-VEGFR-2 antibody, an anti-CD4 antibody, an anti-Met antibody, an anti-CD22 antibody, an anti-G250 antibody, an anti-integrin (CD51) antibody, an anti-integrin av antibody, an anti-hepatocyte growth factor/scatter factor antibody, an anti-PDGFRa antibody, an anti-HGF (hepatocyto growth factor) antibody, an anti-PLGF (placental growth factor) antibody, an anti-c-Met antibody, an anti-myostatin antibody, an anti-EpCAM (CD326) antibody, an anti-EGFL7 (epidermal growth factor domain-like 7) antibody, an anti-EGFR/HER3 bispecific antibody, an anti-LOXL2 (lysyl oxidase-like-2) antibody, an anti-TRAIL R1 antibody, an anti-CD56 antibody, an anti-CD22 antibody, an anti-IL-6 antibody, an anti-GD3 antibody, an anti-FAP (fibroblast activation protein) antibody, an anti-CD221 (insulin-like growth factor 1 receptor) antibody, an anti-CD19/T cell bispecific antibody, an anti-DKK-1 (Dickkopf-1) antibody, an anti-DNA histone complex antibody, an anti-phosphatidyl serine antibody, an anti-angiopoietin-2 antibody, an anti-RI (131I) antibody, an anti-IL-2 antibody, an anti-TNF-α antibody, an anti-CD105 antibody, an anti-IL-1α antibody, an anti-PSCA antibody, an anti-mesothelin antibody, an anti-TEM-1 antibody, an anti-GPNMB antibody, an anti-DR5 antibody, an anti-TF-VIIa antibody, an anti-CD200 (OX-2) antibody, an anti-CD138 antibody, an anti-CD20/CD3 bispecific antibody, an anti-IL-13 antibody, an anti-CD38 antibody, an anti-hPAM4 antibody, an anti-CD74 antibody, an anti-MUC5AC antibody, and an anti-CD40 antibody is preferred.

Examples of the anti-CD20 antibody include rituximab, ibritumomab tiuxetan, tositumomab, ofatumumab, obinutuzumab, obinutuzumab, and veltuzumab. Examples of the anti-HER2 antibody include trastuzumab, pertuzumab, trastuzumab emtansine, RG3502, and Rexomun. Examples of the anti-HER3 antibody include patritumab, AMG888, and SAR256212. Examples of the anti-EGFR antibody include cetuximab, panitumumab, nimotuzumab, Sym004, necitumumab, and RG7160. Examples of the anti-VEGF antibody include bevacizumab and ramucirumab. Examples of the anti-CD33 antibody (calicheamicin-conjugated) include gemtuzumab ozogamicin. Examples of the anti-CD52 antibody include alemtuzumab. Examples of the anti-CD19/CD3 antibody include blinatumomab, MEDI-551, and SAR3419. Examples of the anti-RANKL antibody include denosumab. Examples of the anti-CD30 antibody include brentuximab vedotin. Examples of the anti-CCR4 antibody include mogamulizumab. Examples of the anti-folate receptor antibody include farletuzumab. Examples of the anti-glypican antibody include codrituzumab. Examples of the anti-CD26 antibody include YS110. Examples of the anti-IGF antibody include MEDI-573. Examples of the anti-B7-H3 antibody include DS-5573. Examples of the anti-EPHA antibody include DS-8895. Examples of the anti-IGFR1 antibody include ganitumab and dalotuzumab. Examples of the anti-GD2 (ganglioside) antibody include APN311 and APN301. Examples of the anti-EDb (fibronectin) antibody include L19-131I. Examples of the anti-CS1 antibody include elotuzumab. Examples of the anti-VEGFR-2 antibody include ramucirumab. Examples of the anti-CD4 antibody include zanolimumab. Examples of the anti-Met antibody include onartuzumab. Examples of the anti-CD22 antibody include inotuzumab and ozogamicin. Examples of the anti-G250 antibody include Rencarex (trade name) and girentuximab. Examples of the anti-integrin (CD51) antibody include EMD525797. Examples of the anti-integrin av antibody include intetumumab. Examples of the anti-hepatocyte growth factor/scatter factor antibody include rilotumumab. Examples of the anti-PDGFRantibody include MEDI-575 and olaratumab. Examples of the anti-HGF (hepatocyto growth factor) antibody include ficlatuzumab. Examples of the anti-PLGF (placental growth factor) antibody include TB-403. Examples of the anti-c-Met antibody include LY2875358. Examples of the anti-myostatin antibody include LY2495655. Examples of the anti-EpCAM (CD326) antibody include adecatumumab and VB4-835. Examples of the anti-EGFL7 (epidermal growth factor domain-like 7) antibody include RG7414. Examples of the anti-EGFR/HER3 bispecific antibody include RG7597. Examples of the anti-LOXL2 (lysyl oxidase-like-2) antibody include GS-6624. Examples of the anti-TRAIL R1 antibody include mapatumumab. Examples of the anti-CD56 antibody include lorvotuzumab mertansine. Examples of the anti-CD22 antibody include epratuzumab and IMMU-102. Examples of the anti-IL-6 antibody include siltuximab and ALD518. Examples of the anti-GD3 antibody include ecromeximab. Examples of the anti-FAP (fibroblast activation protein) antibody include sibrotuzumab. Examples of the anti-CD221 (insulin—like growth factor 1 receptor) antibody include robatumumab. Examples of the anti-CD19/T cell bispecific antibody include blinatumomab. Examples of the anti-DKK-1 (Dickkopf-1) antibody include BHQ880. Examples of the anti-DNA histone complex antibody include Cotara mAb TNT (trade name). Examples of the anti-phosphatidylserine antibody include Tarvaci bavituximab (trade name). Examples of the anti-angiopoietin-2 antibody include PF-04856884. Examples of the anti-RI (131I) antibody include radretumab. Examples of the anti-IL-2 antibody include DARLEUKIN and TELEUKIN. Examples of the anti-TNF-α antibody include FIBROMUN. Examples of the anti-CD105 antibody include TRC105. Examples of the anti-IL-la antibody include XILONIX. Examples of the anti-PSCA antibody include AGS-1C4D4. Examples of the anti-mesothelin antibody include amatuximab. Examples of the anti-TEM-1 antibody include ontecizumab. Examples of the anti-GPNMB antibody include glembatumumab vedotin. Examples of the anti-DR5 antibody include tigatuzumab. Examples of the anti-TF-VIIa antibody include ALT-836. Examples of the anti-CD200 (OX-2) antibody include samalizumab. Examples of the anti-CD138 antibody include BT-062. Examples of the anti-CD20/CD3 bispecific antibody include Lymphomun. Examples of the anti-IL-13 antibody include RG3637. Examples of the anti-CD38 antibody include daratuzumab. Examples of the anti-hPAM4 antibody include IMMU-107. Examples of the anti-CD74 antibody include milatuzumab. Examples of the anti-MUC5AC antibody include ensituximab. Examples of the anti-CD40 antibody include lucatumumab.

A publicly known chemotherapeutic agent or a chemotherapeutic agent that will be developed in the future can be suitably used in the chemotherapy. The chemotherapeutic agent is preferably at least one selected from the group consisting of, for example, an alkylating agent, a nitrosourea agent, an antimetabolite, an anticancer antibiotic, a plant-derived alkaloid, a topoisomerase inhibitor, a hormone therapeutic agent, a hormone antagonist, an aromatase inhibitor, a P glycoprotein inhibitor, and a platinum complex derivative.

Examples of the chemotherapeutic agent include the following: alkylating agents, for example, thiotepa and cyclophosphamide; alkyl sulfonates, for example, busulfan, improsulfan, and piposulfan; aziridines, for example, benzodopa, carboquone, meturedopa, and uredopa; ethylenimines and methylamelamines, for example, altretamine, triethylenemelamine, trietylenephosphoramide, triethiylenethiophosphoramide, and trimethylolomelamine; TLK286 (TELCYTA (trademark)); acetogenins (particularly, bullatacin and bullatacinone); δ-9-tetrahydrocannabinol (dronabinol, MARINOL®); β-lapachone; lapachol; colchicine; betulic acid; camptothecin (including synthetic analogs topotecan (HYCAMTIN®), CPT-11 (irinotecan, CAMPTOSAR®), acetylcamptothecin, scopoletin, and 9-aminocamptothecin); bryostatin; kallistatin; CC-1065 (including its synthetic analogs adozelesin, carzelesin, and bizelesin); podophyllotoxin; podophyllinic acid; teniposide; cryptophycins (particularly, cryptophycin 1 and cryptophycin 8); dolastatin; duocarmycin (including synthetic analogs KW-2189 and CB1-TM1); eleutherobin; pancratistatin; sarcodictyin; spongistatin; nitrogen mustards, for example, chlorambucil, chlornaphazine, cholophosphamide, estramustine, ifosfamide, mechlorethamine, mechlorethamine oxide hydrochloride, melphalan, novembichin, phenesterine, prednimustine, trofosfamide, and uracil mustard; nitrosureas, for example, carmustine, chlorozotocin, fotemustine, lomustine, nimustine, and ranimnustine; bisphosphonates, for example, chlodronate; antibiotics, for example, enediyne antibiotics (e.g., calicheamicins, particularly, calicheamicin yIl and calicheamicin wIl (see e.g., Agnew, Chem Intl. Ed. Engl., Vol. 33: p. 183-186 (1994)) as well as anthracycline, for example, annamycin, AD32, alcarubicin, daunorubicin, dexrazoxane, DX-52-1, epirubicin, GPX-100, idarubicin, KRN5500, menogaril, dynemicin, for example, dynemicin A, esperamicin, neocarzinostatin chromophore and related chromoprotein enediyne antibiotic chromophore, aclacinomysin, actinomycin, authramycin, azaserine, bleomycin, cactinomycin, carabicin, carminomycin, carzinophilin, chromomycinis, dactinomycin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin, liposome doxorubicin, and deoxy-doxorubicin), esorubicin, marcellomycin, mitomycin, for example, mitomycin C, mycophenolic acid, nogalamycin, olivomycin, peplomycin, potfiromycin, puromycin, quelamycin, rodorubicin, streptonigrin, streptozocin, tubercidin, ubenimex, zinostatin, and zorubicin; folic acid analogs, for example, denopterin, pteropterin, and trimetrexate; purine analogs, for example, fludarabine, 6-mercaptopurine, thiamiprine, and thioguanine; pyrimidine analogs, for example, ancitabine, azacytidine, 6-azauridine, carmofur, cytarabine, dideoxyuridine, doxifluridine, enocitabine, and floxuridine; androgens, for example, calusterone, dromostanolone propionate, epitiostanol, mepitiostane, and testolactone; anti-adrenals, for example, aminoglutethimide, mitotane, and trilostane; folic acid replenishers, for example, folinic acid (leucovorin); aceglatone; antifolic anti-malignant tumor drugs, for example, ALIMTA®, LY231514 pemetrexed, dihydrofolate reductase inhibitors, for example, methotrexate, antimetabolites, for example, 5-fluorouracil (5-FU) and its prodrugs, for example, UFT, S-1, and capecitabine, and thymidylate synthase inhibitors and glycinamide ribonucleotide formyltransferase inhibitors, for example, raltitrexed (TOMUDEX®, TDX); dihydropyrimidine dehydrogenase inhibitors, for example, eniluracil; aldophosphamide glycoside; aminolevulinic acid; amsacrine; bestrabucil; bisantrene; edatraxate; defofamine; demecolcine; diaziquone; elfornithine; elliptinium acetate; epothilone; ethoglucid; gallium nitrate; hydroxyurea; lentinan; lonidainine; maytansinoids, for example, maytansine and ansamitocin; mitoguazone; mitoxantrone; mopidanmol; nitraerine; pentostatin; phenamet; pirarubicin; losoxantrone; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (particularly, T-2 toxin, verracurin A, roridin A, and anguidine); urethane; vindesine (ELDISINE®, FILDESIN®; dacarbazine; mannomustine; mitobronitol; mitolactol; pipobroman; gacytosine; arabinoside ("Ara-C"); cyclophosphamide; thiotepa; taxane; chloranbucil; gemcitabine (GEMZAR®); 6-thioguanine; mercaptopurine; platinum; platinum analogs or platinum-based analogs, for example, cisplatin, oxaliplatin, and carboplatin; vinblastine (VELBAN®); etoposide (VP-16); ifosfamide; mitoxantrone; vincristine (ONCOVIN®); vinca alkaloids; vinorelbine (NAVELBINE®); novantrone; edatrexate; daunomycin; aminopterin; Xeloda; ibandronate; topoisomerase inhibitor RFS 2000; difluorometlhylornithin (DMFO); retinoids, for example, retinoic acid; pharmaceutically acceptable salts, acids, or derivatives of any of those described above; and combinations of two or more of those described above, for example, CHOP (abbreviation for combination therapy of cyclophosphamide, doxorubicin, vincristine, and prednisolone) and FOLFOX (abbreviation for a treatment regimen with oxaliplatin (ELOXATIN™) used in combination with 5-FU and leucovorin).

This definition also includes the following: antihormonal drugs that act to control or inhibit hormone effects on tumor, for example, anti-estrogen drugs and selective estrogen receptor modulators (SERMs), for example, tamoxifen (e.g., NOLVADEX® tamoxifen), raloxifene, droloxifene, 4-hydroxytamoxifen, trioxifene, keoxifene, LY117018, onapristone, and FARESTON® toremifene; aromatase inhibitors; anti-androgen drugs, for example, flutamide, nilutamide, bicalutamide, leuprolide, and goserelin; troxacitabine (1,3-dioxolane nucleoside cytosine analog); antisense oligonucleotides, particularly, inhibiting the expression of a gene in a signaling pathway involved in abnormal cell growth, for example, PKC-α, Raf, H-Ras, and epithelial growth factor receptor (EGF-R); vaccines, for example, gene therapy vaccines, for example, ALLOVECTIN® vaccine, LEUVECTIN® vaccine, and VAXID® vaccine; PROLEUKIN® rIL-2; LURTOTECAN® topoisomerase 1 inhibitor; ABARELIX® rmRH; and pharmaceutically acceptable salts, acids, or derivatives of any of those described above.

"Taxane" is a chemotherapeutic agent that inhibits mitosis and interferes with microtubules. Examples of the taxane include: paclitaxel (TAXOL®; Bristol-Myers Squibb Oncology, Princeton, N.J.); albumin-modified nanoparticle preparations of paclitaxel excluding Cremophor, and nab-paclitaxel (ABRAXANE (trademark); American Pharmaceutical Partners, Schaumberg, Ill.); and docetaxel (TAXOTERE®; Rhone-Poulenc Rorer, Antony, France).

"Anthracycline" is an antibiotic of type derived from a fungus *Streptococcus peucetius*. Examples thereof include daunorubicin, doxorubicin, and epirubicin.

"Anthracycline-based chemotherapy (chemotherapeutic agent)" refers to a regimen of chemotherapy (chemotherapeutic agent) consisting of or comprising one or more anthracyclines. Examples thereof include: 5-FU, epirubicin, and cyclophosphamide (FEC); 5-FU, doxorubicin, and cyclophosphamide (FAC); doxorubicin and cyclophosphamide (AC); and epirubicin and cyclophosphamide (EC).

"Carboplatin-based chemotherapy (chemotherapeutic agent)" refers to a regimen of chemotherapy (chemotherapeutic agent) consisting of or comprising one or more carboplatins. One example thereof is TCH (docetaxel/TAXOL®, carboplatin, and trastuzumab/HERCEPTIN®).

"Aromatase inhibitor" inhibits an enzyme aromatase which controls estrogen production in the adrenal gland. Examples of the aromatase inhibitor include 4(5)-imidazole, aminoglutethimide, MEGASE® megestrol acetate, AROMASIN® exemestane, formestane, fadrozole, RIVISOR® vorozole, FEMARA® letrozole, and ARIMIDEX® anastrozole. In one embodiment, the aromatase inhibitor used herein is letrozole or anastrozole.

"Antimetabolite chemotherapy" is use of an agent that is structurally similar to metabolites, but cannot be used by the body for proliferative properties. Many antimetabolite chemotherapies hinder the production of nucleic acids, RNA and DNA. Examples of the chemotherapeutic agent which is an antimetabolite include gemcitabine (GEMZAR®), 5-fluorouracil (5-FU), capecitabine (XELODA (trademark)), 6-mercaptopurine, methotrexate, 6-thioguanine, pemetrexed, raltitrexed, arabinosyl cytosine ARA-C cytarabine (CYTOSAR U®), dacarbazine (DTIC-DOME®), azocytosine, deoxycytosine, pyridmidene, fludarabine (FLUDARA®), cladrabine, and 2-deoxy-D-glucose.

<Example> Preparation of humanized anti-FSTL1 antibody

<Construction of antibody expression vector>

The sequence of humanized #6-55 H(2)-L(1) was designed for the purpose of optimizing a lead antibody. Specifically, bovine α lactalbumin sequences were adopted as the signal sequences of H and L chains. Human IgG4 was adopted as the constant region of the H chain, and λ chain was adopted as the constant region of the L chain. HindIII and XhoI restriction sites were added to the 5' and 3' ends, respectively, of antibody genes encoding these sequences. The H chain and L chain genes were artificially synthesized for the optimized humanized antibody (the nucleotide sequence of the H chain: SEQ ID NO: 1007, the amino acid sequence of the H chain: SEQ ID NO: 1008, the nucleotide sequence of the L chain: SEQ ID NO: 1009, the amino acid sequence of the L chain: SEQ ID NO: 1010). The synthesized antibody genes and the pcDNA3.4 expression vectors having an insert of a multicloning site, prepared in Example 3 of PART 1, were treated with HindIII and XhoI. The restriction enzyme-treated antibody genes were integrated to the pcDNA3.4 expression vectors using Ligation high ver 2 (Toyobo Co., Ltd., Cat. No. LGK-201) to construct H chain and L chain antibody expression vectors.

Nucleotide sequence of the H chain: SEQ ID NO: 1007 (the bovine α lactalbumin-derived signal sequence was underlined, and the constant region was underlined with a double line)

ATGATGTCCTTTGTCTCTCTGCTCCTGGTTGGCATCCTATTCCATGCCAC
CCAGGCCGAGGTGCAGCTGTTGGAGTCTGGGGGAGGACTGGTGCAGCCTG
GCGGAAGCCTGAGACTGTCTTGTGCCGCCAGCGGCTTCACCTTCAGCAGC
GTGACAATGCAGTGGGTGCGCCAGGCCCCTGGCAAGGGACTGGAATTTGT
GTCCAGCGTGTGCAGCGGCAGCAGCACCTATTATGCCCCTGCCGTGAAGG
GCCGGTTCACCATCTCCCGGGACAACAGCAAGAACACCGTGTACCTGCAG
ATGAACAGCCTGCGGGCCGAGGACACCGCCGTGTACTACTGTGCCAAGAT
CGCCGGCAGAGCCCGGTGGTCTTGTACCAGCGCCGCCTACAACATCGACG
CCTGGGGACAGGGAACCCTCGTGACAGTGTCTAGCGCCAGCACCAAGGGC
CCCAGCGTGTTCCCTCTGGCCCCTTGTAGCAGAAGCACCAGCGAGTCTAC
AGCCGCCCTGGGCTGCCTCGTGAAGGACTACTTTCCCGAGCCCGTGACCG
TGTCCTGGAACTCTGGCGCTCTGACAAGCGGCGTGCACACCTTTCCAGCC
GTGCTGCAGAGCAGCGGCCTGTACTCTCTGAGCAGCGTCGTGACTGTGCC
CAGCAGCTCTCTGGGCACCAAGACCTACACCTGTAACGTGGACCACAAGC
CCAGCAACACCAAGGTGGACAAGCGGGTGGAATCTAAGTACGGCCCTCCC
TGCCCTCCTTGCCCAGCCCCTGAATTTCTGGGCGGACCCTCCGTGTTCCT
GTTCCCCCCAAAGCCCAAGGACACCCTGATGATCAGCCGGACCCCCGAAG
TGACCTGCGTGGTGGTGGATGTGTCCCAGGAAGATCCCGAGGTGCAGTTC
AATTGGTACGTGGACGGCGTGGAAGTGCACAACGCCAAGACCAAGCCTAG
AGAGGAACAGTTCAACAGCACCTACCGGGTGGTGTCCGTGCTGACAGTGC
TGCATCAGGACTGGCTGAACGGCAAAGAGTACAAGTGCAAGGTGTCCAAC
AAGGGCCTGCCCAGCTCCATCGAGAAAACCATCAGCAAGGCCAAGGGCCA
GCCCCGCGAACCCCAGGTGTACACACTGCCTCCAAGCCAGGAAGAGATGA
CCAAGAACCAGGTGTCCCTGACCTGTCTCGTGAAAGGCTTCTACCCCTCC
GATATCGCCGTGGAATGGGAGAGCAACGGCCAGCCCGAGAACAACTACAA
GACAACCCCCCCTGTGCTGGACAGCGACGGCTCATTCTTCCTGTACAGCA
GACTGACCGTGGACAAGAGCCGGTGGCAGGAAGGCAACGTGTTCAGCTGC
AGCGTGATGCACGAGGCCCTGCACAACCACTACACCCAGAAGTCCCTGTC
TCTGAGCCTGGGCAAGTGA

Amino acid sequence of the H chain: SEQ ID NO: 1008 (the bovine α lactalbumin-derived signal sequence was underlined, and the constant region was underlined with a double line)

MMSFVSLLLVGILFHATQAEVQLLESGGGLVQPGGSLRLSCAASGFTFSS
VTMQWVRQAPGKGLEWFVSSVCSGSSTYYAPAVKGRFTISRDNSKNTVYL
QMNSLRAEDTAVYYCAKIAGRARWSCTSAAYNIDAWGQGTLVTVSSASTK
GPSVFPLAPCSRSTSESTAALGCLVKDYFPEPVTVSWNSGALTSGVHTFP
AVLQSSGLYSLSSVVTVPSSSLGTKTYTCNVDHKPSNTKVDKRVESKYGP
PCPPCPAPEFLGGPSVFLFPPKPKDTLMISRTPEVTCVVVDVSQEDEPVQ
FNWYVDGVEVHANKTKPREEQFNSTYRVVSVLTVLHQDWLNGKEYKCKVS
NKGLPSSIEKTISKAKGQPREPQVYTLPPSQEEMTKNQVSLTCLVKGFYP
SDIAVEWESNGQPENNYKTTPPVLDSDGSFFLYSRLTVDKSRWQEGNVFS
CSVMHEALHNHYTQKSLSLSLGK

Nucleotide sequence of the L chain: SEQ ID NO: 1009 (the bovine α lactalbumin-derived signal sequence was underlined, and the constant region was underlined with a double line)

ATGATGTCCTTTGTCTCTCTGCTCCTGGTTGGCATCCTATTCCATGCCAC
CCAGGCCAGCTATGAGCTGACTCAGCCACCCAGCGTGTCCGTGTCTCCTG
GCCAGACCGCCAGAATCACCTGTAGCGGCGGAGGCAACAACTACGGCTGG
TATCAGCAGAAGCCCGGCCAGGCCCCTGTGACCGTGATCTACTACAACGA
CAACCGGCCCAGCGGCATCCCCGAGAGATTCAGCGGCAGCAATAGCGGCT
CCACCACCACCCTGACAATCAGCGGAGTGCAGGCCGAGGACGAGGCCGAT
TACTACTGCGGCAGCTGGGACAGCAACACCGACTCCGGCATCTTTGGCGG
CGGAACCAAGCTGACCGTCCTGGGTCAGCCCAAGGCTGCCCCCTCGGTCA
CTCTGTTCCCGCCCTCCTCTGAGGAGCTTCAAGCCAACAAGGCCACACTG
GTGTGTCTCATAAGTGACTTCTACCCGGGAGCCGTGACAGTGGCCTGGAA
GGCAGATAGCAGCCCCGTCAAGGCGGGAGTGGAGACCACCACACCCTCCA
AACAAAGCAACAACAAGTACGCGGCCAGCAGCTATCTGAGCCTGACGCCT
GAGCAGTGGAAGTCCCACAGAAGCTACAGCTGCCAGGTCACGCATGAAGG
GAGCACCGTGGAGAAGACAGTGGCCCCTACAGAATGTTCATAG

Amino acid sequence of the L chain: SEQ ID NO: 1010 (the bovine α lactalbumin-derived signal sequence was underlined, and the constant region was underlined with a double line)

MMSFVSLLLVGILFHATQASYELTQPPSVSVSPGQTARITCSGGGNNYGW
YQQKPGQAPVTVIYYNDNRPSGIPERFSGSNSGSTTTLTISGVQAEDEAD
YYCGSWDSNTDSGIFGGGTKLTVLGQPKAAPSVTLFPPSSEELQANKATL
VCLISDFYPGAVTVAWKADSSPVKAGVETTTPSKQSNNKYAASSYLSLTP
EQWKSHRSYSCQVTHEGSTVEKTVAPTECS

<Production of Humanized Antibody>

For the large-scale production of the optimized humanized antibody, cultured mammalian cells were transfected with the prepared H chain and L chain antibody expression vectors using ExpiCHO Expression system (Invitrogen Corp., Cat # A29133). Then, a culture supernatant was recovered and purified as shown in Table 5 below.

TABLE 5

| | Approach | Carrier |
|---|---|---|
| Primary purification | Affinity | MabSelect SuRe (GE Healthcare Japan Corp., Code No.17543802) |
| Secondary purification | Hydrophobic interaction | Phenyl Sepharose High Performance (GE Healthcare Japan Corp., Code No.29018184) |
| Tertiary purification | Cation-exchange | SP Sepharose High Performance (GE Healthcare Japan Corp., Code No.29018183) |

<Binding Activity Measurement>

The binding activity of the obtained purified antibody against FSTL1 was measured by use of the BLI method (BLItz, Pall Corp., 45-5000). The antigen was biotinylated using EZ-Link NHS-PEG4-Biotin (Thermo Fisher Scientific Inc., 21329). Streptavidin Tray (Pall Corp., 18-5019) was used as a sensor chip for the BLI method. The sensor chip was hydrated with PBS (Wako Pure Chemical Industries, Ltd., 166-23555) for 10 minutes or longer. 5 ug/ml of the biotinylated antigen was immobilized onto the hydrated sensor chip for 300 seconds. The antibody was adjusted to 40, 20, 10, 5, 2.5, or 0 ug/ml and reacted therewith for 120 seconds, and dissociation was measured for 300 seconds. When the antibody concentration of 0 ug/ml was used as a reference, the KD value was calculated. As a result of calculating the KD value, the $K_D$ value of the optimized humanized antibody was $1.09 \times 10^{-8}$ M.

SEQUENCE LISTING (1010 sequences)

SEQ ID NO: 1 - DNA, 927 bp, homo sapiens
  CDS (1)..(927)
  sig_peptide (1)..(60)
atgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaa

SEQ ID NO: 2 - protein, 308 aa, homo sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 3 - DNA, 921 bp, Mus musculus
  CDS (1)..(921)
  sig_peptide (1)..(54)
atgtggaaacgatggctggcgctctcgctggtgaccatcgccctggtccacggcgaggaggaacctagaagcaaatccaagatctgcgccaatgtgttttgtggagctggcagggaatgtgccgtcacagagaagggggagcccacgtgcctctgcattgagcaatgcaaacctcacaagaggcctgtgtgtggcagtaatggcaagacctacctcaaccactgtgaacttcatagagatgcctgcctcactggatccaagatccaggttgattatgatgggcactgcaaagaaaagaagtctgcgagtccatctgccagcccagttgtctgctatcaagctaaccgcgatgagctccgacggcgcctcatccagtggctggaagctgagatcattccagatggctggttctctaaaggcagtaactacagtgagatcctagacaagtactttaagagctttgataatggcgactctcacctggactccagtgaattcctgaaattcgtggagcagaatgaaacagccatcaacatcaccacttatgcagatcaggagaacaacaaactgctcagaagcctctgtgttgacgccctcattgaactgtctgatgagaacgctgactggaaactcagcttccaagagttcctcaagtgcctcaacccatccttcaaccctcctgagaagaagtgtgccctggaggacgaaacctatgcagatggagctgagactgaggtggactgcaatcgctgtgtctgttcctgtggccactgggtctgcacagcaatgacctgtgatggaaagaatcagaagggggtccagacccacacagaggaggagaagacaggatatgtccaggaactccagaagcaccagggcacagcagaaaagaccaagaaggtgaacaccaaagagatctaa

SEQ ID NO: 4 - protein, 306 aa, Mus musculus
MWKRWLALSLVTIALVHGEEEPRSKSKICANVFCGAGRECAVTEKGEPTCLCIEQCKPHKRPVCGSNGKTYLNHCELHRDACLTGSKIQVDYDGHCKEKKSASPSASPVVCYQANRDELRRRLIQWLEAEIIPDGWFSKGSNYSEILDKYFKSFDNGDSHLDSSEFLKFVEQNETAINITTYADQENNKLLRSLCVDALIELSDENADWKLSFQEFLKCLNPSFNPPEKKCALEDETYADGAETEVDCNRCVCSCGHWVCTAMTCDGKNQKGVQTHTEEEKTGYVQELQKHQGTAEKTKKVNTKEI

SEQ ID NO: 5 - DNA, 318 bp, artificial sequence
  light chain variable region of antibody clone #5-2
  CDS (1)..(318)
gctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttccaaatccggctccacagccacattaaccatcactggggtccaagccgaggacgaggctgtctatttctgtggtggctacgacagcagtactggtcatggtggtatatttggggccgggacaaccctgaccgtccta

SEQ ID NO: 6 - protein, 106 aa, artificial sequence
  Synthetic Construct
ASTQPSSVSANPGEAVKITCSGGSGSYYGWYQQKSPGSAPVTVIYNNNQRPSDIPSRFSGSKSGSTATLTITGVQAEDEAVYFCGGYDSSTGHGGIFGAGTTLTVL

SEQ ID NO: 7 - DNA, 381 bp, artificial sequence
  heavy chain variable region of antibody clone #5-2
  CDS (1)..(381)
gcggtgacgttggacgagtccgggggcggcctccagacgcccggaggagggctcagcctcgtctgcaagggctccgggttcaccttcagcagcttcaacatgttctgggtgcgacaggctccaggcaaggggctggagtgggtcgctggtgttggcaaggatggtggtacaggatacggggcggcggtggatggccgtgccaccatctcaaaggacaacgggcagagcacactgaggctgcagctgaacaacctcagggctgaggacaccggcacctactactgcgccaaagctgctggtggttgtagttacggttggtgtggttcttatgttggtgatatcgacgcatggggccacgggaccgaagtcatcgtctcctcc

SEQ ID NO: 8 - protein, 127 aa, artificial sequence
  Synthetic Construct
AVTLDESGGGLQTPGGGLSLVCKGSGFTFSSFNMFWVRQAPGKGLEWVAGVGKDGGTGYGAAVDGRATISKDNGQSTLRLQLNNLRAEDTGTYYCAKAAGGCSYGWCGSYVGDIDAWGHGTEVIVSS

SEQ ID NO: 9 - DNA, 312 bp, artificial sequence
  light chain variable region of antibody clone #5-3
  CDS (1)..(312)
gctagcactcagccgtcctcggtgtcagcaaacccaggagaaaccgtcaagatcacctgctccgggggtagtggctactactatggctggtatcagcagaagtctcctggcagtgtccctgtcactgtgatctataacaacaacaacagaccctcggacatcccgtcacgattctccggttccaaatccggctccacaggcacattaaccatcactggggtccgagccgaggacgaggctgtctattattgtggaggctacgacaacagcggtactggtatatttggggccgggacaaccctgaccgtccta

SEQ ID NO: 10 - protein, 104 aa, artificial sequence
  Synthetic Construct
ASTQPSSVSANPGETVKITCSGGSGYYYGWYQQKSPGSVPVTVIYNNNNRPSDIPSRFSGSKSGSTGTLTITGVRAEDEAVYYCGGYDNSGTGIFGAGTTLTVL

SEQ ID NO: 11 - DNA, 381 bp, artificial sequence
  heavy chain variable region of antibody clone #5-3
  CDS (1)..(381)
gcggtgacgttggacgagtccgggggcggcctccagacgcccggaggagcgctcagcctcgtctgcaagggctccgggttctccttcagcagcttcaacatgttctgggtgcgccaggcgcccggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctcc

SEQ ID NO: 12 - protein, 127 aa, artificial sequence
  Synthetic Construct
AVTLDESGGGLQTPGGALSLVCKGSGFSFSSFNMFWVRQAPGKGLEWVAGIGKDGVPKYGAAVDGRATISKDNGQSTMRLQLNNLRAEDTGTYFCAKAAGGCSYDWCGIYAGDIDTWGHGTEVIVSS

SEQ ID NO: 13 - DNA, 318 bp, artificial sequence; identical to SEQ ID NO: 5
  light chain variable region of antibody clone #5-8
  CDS (1)..(318)

SEQ ID NO: 14 - protein, 106 aa, artificial sequence; identical to SEQ ID NO: 6
  Synthetic Construct

SEQ ID NO: 15 - DNA, 381 bp, artificial sequence
  heavy chain variable region of antibody clone #5-8
  CDS (1)..(381)
gcggtgacgttggacgagtccgggggcggcctccagacgcccggaggagggctcagcctcgtctgcaagggctccgggttcaccttcagcagtttcaacatgttctgggtgcgacaggctccaggcaaggggctggagtgggtcgctggtataggcaaggatggtgttccaaaatacgggacggcggtggatggccgcgccaccatctcgaaggacaacgggcagagcacaatgaggctgcagctgaacaacctcagggctgaggacaccggcacctacttctgcgccaaagctgctggtggttgtagttacgattggtgtggtatttatactggtgacatcgacacatggggccacgggaccgaagtcatcgtctcctcc

SEQ ID NO: 16 - protein, 127 aa, artificial sequence
  Synthetic Construct
AVTLDESGGGLQTPGGGLSLVCKGSGFTFSSFNMFWVRQAPGKGLEWVAGIGKDGVPKYGTAVDGRATISKDNGQSTMRLQLNNLRAEDTGTYFCAKAAGGCSYDWCGIYTGDIDTWGHGTEVIVSS

SEQ ID NO: 17 - DNA, 324 bp, artificial sequence
  light chain variable region of antibody clone #5-10
  CDS (1)..(324)
gctagcactcagccgtcctcggtgtcagcaaacccaggagaaaccgtcaagatcacctgctccgggggtggcagctatgttggaagttactattatggctggtatcagcagaagtctcctggcagtgcccctgtcactgtgatctataacaacaaccagagaccctcggacatcccttcacgattctccggttctaaatccggctccacggccacattaaccatcactggggtccaagccgaggacgaggctgtctatttctgtggtggctacgacagcagtgctggtggtatatttggggccgggacaaccctgaccgtccta

SEQ ID NO: 18 - protein, 108 aa, artificial sequence
  Synthetic Construct
ASTQPSSVSANPGETVKITCSGGGSYVGSYYYGWYQQKSPGSAPVTVIYNNNQRPSDIPSRFSGSKSGSTATLTITGVQAEDEAVYFCGGYDSSAGGIFGAGTTLTVL

SEQ ID NO: 19 - DNA, 381 bp, artificial sequence
  heavy chain variable region of antibody clone #5-10
  CDS (1)..(381)
gcggtgacgttggacgagtccgggggcggcctccagacgcccggaggagggctcagcctcgtctgcaagggctccgggttcaccctcagtagcttcaacatgttctgggtgcgacaggcgcccggcaagggactggaatgggtcgctggtgttggcaaggatggtggtacaacttatggggcggcggtggatggccgtgccaccatctcgagggacagcgggcagagtacagtgaggctgcagctgaacgacctcagggctgaggacaccggcacctacttctgcgccaaagctgctggtggttgtagttacagttggtgtggtgcttatgttggtgatctcgacgcatggggccacgggaccgaagtcatcgtctcctcc

SEQ ID NO: 20 - protein, 127 aa, artificial sequence
  Synthetic Construct
AVTLDESGGGLQTPGGGLSLVCKGSGFTLSSFNMFWVRQAPGKGLEWVAGVGKDGGTTYGAAVDGRATISRDSGQSTVRLQLNDLRAEDTGTYFCAKAAGGCSYSWCGAYVGDLDAWGHGTEVIVSS

SEQ ID NO: 21 - DNA, 318 bp, artificial sequence; identical to SEQ ID NO: 5
  light chain variable region of antibody clone #5-43
  CDS (1)..(318)

SEQ ID NO: 22 - protein, 106 aa, artificial sequence; identical to SEQ ID NO: 6
  Synthetic Construct

SEQ ID NO: 23 - DNA, 381 bp, artificial sequence
  heavy chain variable region of antibody clone #5-43
  CDS (1)..(381)
gcggtgacgttggacgagtccgggggcggcctccagacgcccggaggagggctcagcctcgtctgcaagggctccggcttcaccttcagcagcttcaacatgttctgggtgcgacaggctccaggcaaggggctggagtgggtcgctggtattggcaaggatggtggtacaggatacggggcggcggtggatggccgtgccaccatctcgaaggacagcgggcagagcactctgaggctgcagctgaacaacctcagggctgaggacaccggcacctactactgcgccaaagctgctggtggttgtagttacgattggtgtggtgcttatactggtgacatcgacacatggggccacgggaccgaagtcatcgtctcctcc

SEQ ID NO: 24 - protein, 127 aa, artificial sequence
  Synthetic Construct
AVTLDESGGGLQTPGGGLSLVCKGSGFTFSSFNMFWVRQAPGKGLEWVAGIGKDGGTGYGAAVDGRATISKDSGQSTLRLQLNNLRAEDTGTYYCAKAAGGCSYDWCGAYTGDIDTWGHGTEVIVSS

SEQ ID NO: 25 - DNA, 312 bp, artificial sequence
  light chain variable region of antibody clone #6-55
  CDS (1)..(312)
gctagcactcagccgtcctcggtgtcagcaatcccaggagaaaccgtcaagatcacctgctccgggggtggcaacaactatggctggtaccagcagaggtctcctggcagtgcccctgtcactgtgatctattacaacgacaacagaccctcgaacatcccttcacgattctccggttccacatccggctccacaagcacattaaccatcactggggtccaagccgacgacgaggctatctattactgtgggagctgggatagcaacactgatagtggtatatttggggccgggacaaccctgaccgtccta

SEQ ID NO: 26 - protein, 104 aa, artificial sequence
  Synthetic Construct
ASTQPSSVSAIPGETVKITCSGGGNNYGWYQQRSPGSAPVTVIYYNDNRPSNIPSRFSGSTSGSTSTLTITGVQADDEAIYYCGSWDSNTDSGIFGAGTTLTVL

SEQ ID NO: 27 - DNA, 378 bp, artificial sequence
  heavy chain variable region of antibody clone #6-55
  CDS (1)..(378)
gcggtgacgttggacgagtccgggggcggcctccagacgcccggaggagcgctcagcctcgtctgcaagggctccgggttcaccttcaccagcgtcaccatgcagtgggtgcgacaggcgcccggcaaggggctcgaatgggtcgctagtgtctgcagtggtagttccacatattacgcgccggcggtgaagggccgtgccaccatctcgagggacaacgggcagagcacagtgaggctgcagctgagcaacctcaggcctgaggacaccggcacgtactactgcgccaaaattgctggtcgtgctaggtggagttgtacaagtgctgcttacaacatcgacgcatggggccacgggaccgaagtcatcgtctcctcc

SEQ ID NO: 28 - protein, 126 aa, artificial sequence
  Synthetic Construct
AVTLDESGGGLQTPGGALSLVCKGSGFTFTSVTMQWVRQAPGKGLEWVASVCSGSSTYYAPAVKGRATISRDNGQSTVRLQLSNLRPEDTGTYYCAKIAGRARWSCTSAAYNIDAWGHGTEVIVSS

SEQ ID NO: 29 - DNA, 312 bp, artificial sequence
  light chain variable region of antibody clone #7-34
  CDS (1)..(312)
gctagcactcagccgtcctcggtgtcagcaaacccaggagaaaccgtcaagatcacctgctccgggggtggcaacaactatggctggtaccagcagaagtctcctggcagtgcccctgtcactgtgatctattacaacaacaacagaccctcgaacatcccttcacgattctccggttccacatccggctccacaagcacattaaccatcactggggtccaagccgaggacgaggctgtctattattgtgggagctacgaaggcagtactgatagtggtatatttggggccgggacaaccctgaccgtccta

SEQ ID NO: 30 - protein, 104 aa, artificial sequence
  Synthetic Construct
ASTQPSSVSANPGETVKITCSGGGNNYGWYQQKSPGSAPVTVIYYNNNRPSNIPSRFSGSTSGSTSTLTITGVQAEDEAVYYCGSYEGSTDSGIFGAGTTLTVL

SEQ ID NO: 31 - DNA, 378 bp, artificial sequence
  heavy chain variable region of antibody clone #7-34
  CDS (1)..(378)
gcggtgacgttggacgagtccgggggcggcctccagacgcccggaggagggctcagcctcgtctgcaaggcctccgggttcaccttcagcagcgtcaccatgcagtgggtgcgacaggcgcccggcaaggggctcgaatgggtcgctagtatttgtagtggtagtagcacatactacgggccggcggtgaagggccgtgccaccatctcgagggacaacgggcagaacacagtgaggctgcagctgaacaacctcagggctgaggacaccgccacctactactgcgccaaaattgttggtcgtggtaggtggagttgtactagtgctgcttataacatcgacgcatggggccacgggaccgaagtcatcgtctcctcc

SEQ ID NO: 32 - protein, 126 aa, artificial sequence
  Synthetic Construct
AVTLDESGGGLQTPGGGLSLVCKASGFTFSSVTMQWVRQAPGKGLEWVASICSGSSTYYGPAVKGRATISRDNGQNTVRLQLNNLRAEDTATYYCAKIVGRGRWSCTSAAYNIDAWGHGTEVIVSS

SEQ ID NO: 33 - DNA, 318 bp, artificial sequence
  light chain variable region of antibody clone #8-1
  CDS (1)..(318)
gctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttccaaatccggctccacagccacattaaccatcactggggtccaagccgaggacgaggctgtctatttctgtggtggctacgacagcagtagtggtcatggtggtatattcggggccgggacaaccctgaccgtccta

SEQ ID NO: 34 - protein, 106 aa, artificial sequence
  Synthetic Construct
ASTQPSSVSANPGEAVKITCSGGSGSYYGWYQQKSPGSAPVTVIYNNNQRPSDIPSRFSGSKSGSTATLTITGVQAEDEAVYFCGGYDSSSGHGGIFGAGTTLTVL

SEQ ID NO: 35 - DNA, 381 bp, artificial sequence
  heavy chain variable region of antibody clone #8-1
  CDS (1)..(381)
gcggtgacgttggacgagtccgggggcggcctccagacgcccggaggagcgctcagcctcgtctgcaagggctccgggttcaccttcagcagcttcaacatgttctgggtgcgacaggctccaggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctcc

SEQ ID NO: 36 - protein, 127 aa, artificial sequence
  Synthetic Construct
AVTLDESGGGLQTPGGALSLVCKGSGFTFSSFNMFWVRQAPGKGLEWVAGIGKDGVPKYGAAVDGRATISKDNGQSTMRLQLNNLRAEDTGTYFCAKAAGGCSYDWCGIYAGDIDTWGHGTEVIVSS

SEQ ID NO: 37 - DNA, 312 bp, artificial sequence
  light chain variable region of antibody clone #8-4
  CDS (1)..(312)
gctagcagtcagccgtcctcggtgtcagcaaacccaggagaaaccgtcaagatcacctgctccgggggtagtggctactactatggctggtatcagcagaagtctcctggcagtgcccctgtcactgtgatctataacaacgacaacaaaccctcagacatcccttcacgattctccggttccaaatccggctccacaggcacattaaccatcactggggtccaagtcgaggacgaggctgtctatttctgtggaggctacgacaacagcggtactggtatatttggggccgggacaaccctgaccgtccta

SEQ ID NO: 38 - protein, 104 aa, artificial sequence
  Synthetic Construct
ASSQPSSVSANPGETVKITCSGGSGYYYGWYQQKSPGSAPVTVIYNNDNKPSDIPSRFSGSKSGSTGTLTITGVQVEDEAVYFCGGYDNSGTGIFGAGTTLTVL

SEQ ID NO: 39 - DNA, 381 bp, artificial sequence
  heavy chain variable region of antibody clone #8-4
  CDS (1)..(381)
gcggtgacgttggacgagtccgggggcggcctccagacgcccggaggagggctcagcctcgtctgcaagggctccgggttcaccctcagtagcttcaacatgttctgggtgcgacaggcgcccggcaagggactggaatgggtcgctggtgttggcaaggatggtggtacagcttatggggcggcggtggatggccgtgccaccatctcgagggacagcgggcagagcacagtgaggctgcagctgaacaacctcagggctgaggacaccggcacctacttctgcgccaaagctgctggtggttgtagttacagttggtgtggtgcttatgttggtgatctcgacgcatggggccacgggaccgaagtcatcgtctcctcc

SEQ ID NO: 40 - protein, 127 aa, artificial sequence
  Synthetic Construct
AVTLDESGGGLQTPGGGLSLVCKGSGFTLSSFNMFWVRQAPGKGLEWVAGVGKDGGTAYGAAVDGRATISRDSGQSTVRLQLNNLRAEDTGTYFCAKAAGGCSYSWCGAYVGDLDAWGHGTEVIVSS

SEQ ID NO: 41 - DNA, 318 bp, artificial sequence; identical to SEQ ID NO: 5
  light chain variable region of antibody clone #8-7
  CDS (1)..(318)

SEQ ID NO: 42 - protein, 106 aa, artificial sequence; identical to SEQ ID NO: 6
  Synthetic Construct

SEQ ID NO: 43 - DNA, 381 bp, artificial sequence
  heavy chain variable region of antibody clone #8-7
  CDS (1)..(381)
gcggtgacgttggacgagtccgggggcggcctccagacgcccggaggagggctcagcctcgtctgcaagggctccgggttcaccttcagcagtttcaacatgttctgggtgcgacaggctccaggcaaggggctggaatgggtcgctggcataggcaaggatggtgttcctaaatacggggcggcggtggacggccgtgccaccatctcgaaggacaacgggcagagcacactgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctcc

SEQ ID NO: 44 - protein, 127 aa, artificial sequence
  Synthetic Construct
AVTLDESGGGLQTPGGGLSLVCKGSGFTFSSFNMFWVRQAPGKGLEWVAGIGKDGVPKYGAAVDGRATISKDNGQSTLRLQLNNLRAEDTGTYFCAKAAGGCSYDWCGIYAGDIDTWGHGTEVIVSS

SEQ ID NO: 45 - DNA, 318 bp, artificial sequence
  light chain variable region of antibody clone #8-8
  CDS (1)..(318)
gctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttctaaatccggctccacggccacattaaccatcactggggtccaagtcgaggacgaggctgtctatttctgtggtggctacgacagcagtactggtcatggtggtatatttggggccgggacaaccctgaccgtccta

SEQ ID NO: 46 - protein, 106 aa, artificial sequence
  Synthetic Construct
ASTQPSSVSANPGEAVKITCSGGSGSYYGWYQQKSPGSAPVTVIYNNNQRPSDIPSRFSGSKSGSTATLTITGVQVEDEAVYFCGGYDSSTGHGGIFGAGTTLTVL

SEQ ID NO: 47 - DNA, 381 bp, artificial sequence
  heavy chain variable region of antibody clone #8-8
  CDS (1)..(381)
gcggtgacgttggacgagtccgggggcggcctccagacgcccggaggagcgctcagcctcgtctgcaagggctccgggttcaccttcagcagcttcaacatgttctgggtgcgacaggctccaggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctactactgcgccaaagctgctggtggttgtagttacggttggtgtggtgcttatactggtgacatcgacacatggggccacgggaccgaagtcatcgtctcctcc

SEQ ID NO: 48 - protein, 127 aa, artificial sequence
  Synthetic Construct
AVTLDESGGGLQTPGGALSLVCKGSGFTFSSFNMFWVRQAPGKGLEWVAGIGKDGVPKYGAAVDGRATISKDNGQSTMRLQLNNLRAEDTGTYYCAKAAGGCSYGWCGAYTGDIDTWGHGTEVIVSS

SEQ ID NO: 49 - DNA, 309 bp, artificial sequence
  light chain variable region of antibody clone #7
  CDS (1)..(309)
  misc_feature (40)..(40): n is a, c, g, or t
  misc_feature (44)..(45): n is a, c, g, or t
gctagcactcagccgtcctcggtgtcagcaaacccagganaaanngtcaagatcacctgctccgggggtggtagcagatatggctggtatcagcagaagtctcctggcagtgcccctgtcactgtgatctattacaacgacaagagaccctcgaacatcccttcacgattctccggttcgaaatccggctccacaggcacattaaccatcactggggtccgagccgaggacgaggctgtctatttctgtggtggctacgacggcagcactgatgctgcatttggggccgggacaaccctgaccgtccta

SEQ ID NO: 50 - protein, 103 aa, artificial sequence
  misc_feature (14)..(14): The 'Xaa' at location 14 stands for Lys, Glu, or Gln.
  misc_feature (15)..(15): The 'Xaa' at location 15 stands for Lys, Asn, Arg, Ser, Thr, Ile, or Met.
  Synthetic Construct
ASTQPSSVSANPGXXVKITCSGGGSRYGWYQQKSPGSAPVTVIYYNDKRPSNIPSRFSGSKSGSTGTLTITGVRAEDEAVYFCGGYDGSTDAAFGAGTTLTVL

SEQ ID NO: 51 - DNA, 390 bp, artificial sequence
  heavy chain variable region of antibody clone #7
  CDS (1)..(390)
gcggtgacgttggacgagtccgggggcggcctccagacgcccggaggagcgctcagcctcgtctgcaaggcctccgggtttttcttctttagcatttatgacatgggttgggtgcgacaggcgcctggcaaagggctggaatgggtcgctggtattgatgattatggtgaatacacaggctacgggtcggcggtgaagggccgtgccaccatctcgagggacaacgggcagagcacagtgaggctgcagctgaacaacctcagggctgaggacaccggcacctactactgcgccagaggtgctggtacgggttgtaatagtgctggttgtggtgcttatgctggcagcatcgacgcatggggccacgggaccgaagtcatcgtctctccg

SEQ ID NO: 52 - protein, 130 aa, artificial sequence
  Synthetic Construct
AVTLDESGGGLQTPGGALSLVCKASGFFFFSIYDMGWVRQAPGKGLEWVAGIDDYGEYTGYGSAVKGRATISRDNGQSTVRLQLNNLRAEDTGTYYCARGAGTGCNSAGCGAYAGSIDAWGHGTEVIVSP

SEQ ID NO: 53 - DNA, 312 bp, artificial sequence
  light chain variable region of antibody clone #10
  CDS (1)..(312)
gctagcactcagccgtcctcggtgtcagcaaacccaggagaaaccgtcaagctcacctgctccgggggtggcagcaggtatggctggtatcagcagaagtcacctggcagtgcccctgtcactgtgatctattacaacgacaagagaccctcggacatcccttcacgattctccggttccaaatccggctccacggccacattaaccatcactggggtccaagccgaggacgaggctgtctatttctgtggtggctacgacggcagcagagatgctggtatatttggggccgggacaaccctgaccgtacta

SEQ ID NO: 54 - protein, 104 aa, artificial sequence
  Synthetic Construct
ASTQPSSVSANPGETVKLTCSGGGSRYGWYQQKSPGSAPVTVIYYNDKRPSDIPSRFSGSKSGSTATLTITGVQAEDEAVYFCGGYDGSRDAGIFGAGTTLTVL

SEQ ID NO: 55 - DNA, 390 bp, artificial sequence
  heavy chain variable region of antibody clone #10
  CDS (1)..(390)
gcggtgacgttggacgagtccgggggcggcctccagacgcccggaggagcgctcagcctcgtctgcaaggcctccgggtttttcttctttaggatttatgacatgggttgggtgcgacaggcgcctggcaaagggctggaatgggtcgctggtattgatgattatggtagatacacaggctacgggtcggcggtgaagggccgtgccaccatctcgagggacaacgggcagagcacagtgaggctgcaactgaacaacctcagggctgaggacaccggcacctactactgcgccagaggtgctggtacgggttgtaatagtgctggttgtggtgcttatgctggtagcatcgacgcatggggccacgggaccgaagtcatcgtctcctcc

SEQ ID NO: 56 - protein, 130 aa, artificial sequence
  Synthetic Construct
AVTLDESGGGLQTPGGALSLVCKASGFFFFRIYDMGWVRQAPGKGLEWVAGIDDYGRYTGYGSAVKGRATISRDNGQSTVRLQLNNLRAEDTGTYYCARGAGTGCNSAGCGAYAGSIDAWGHGTEVIVSS

SEQ ID NO: 57 - DNA, 312 bp, artificial sequence
  light chain variable region of antibody clone #13
  CDS (1)..(312)
gctagcactcagccgtcctcggtgtcagcaaacccaggagaaaccgtcaagatcacctgctccgggggtggcaacaactatggctggtatcagcagaagtctcctggcagtgcccctgtcactgtgatctataacaacaacaacagaccctcgaacatcccttcacgattctccggttccaaatccggctccacaaacacattaaccatcactggggtccaagccgaggacgaggctgtctattactgtgggagctacgacagcagcagtgatagtggtatatttggggccgggacaaccctgaccgtccta

SEQ ID NO: 58 - protein, 104 aa, artificial sequence
  Synthetic Construct
ASTQPSSVSANPGETVKITCSGGGNNYGWYQQKSPGSAPVTVIYNNNNRPSNIPSRFSGSKSGSTNTLTITGVQAEDEAVYYCGSYDSSSDSGIFGAGTTLTVL

SEQ ID NO: 59 - DNA, 378 bp, artificial sequence; identical to SEQ ID NO: 31
  heavy chain variable region of antibody clone #13
  CDS (1)..(378)

SEQ ID NO: 60 - protein, 126 aa, artificial sequence; identical to SEQ ID NO: 32
  Synthetic Construct

SEQ ID NO: 61 - DNA, 318 bp, artificial sequence
  light chain variable region of antibody clone #22
  CDS (1)..(318)
gctagcactcagccgtcctcggtgtcagcaaacccaggagaaaccgtcaagatcacctgctccgggggtagtggcagctatggctggttccagcagaagtctcctggcagtgcccctgtcactgtgatctactgggatgacaggagaccctcagacatcccttcacgattctccggttccaaatccggctccatacacacattaaccatcactggggtccaagccgacgacgaggctgtctatctctgtgggaatgcagtcaggagcggtacgggttatgttggtgtgtttggggccgggacaaccctgaccgtccta

SEQ ID NO: 62 - protein, 106 aa, artificial sequence
  Synthetic Construct
ASTQPSSVSANPGETVKITCSGGSGSYGWFQQKSPGSAPVTVIYWDDRRPSDIPSRFSGSKSGSIHTLTITGVQADDEAVYLCGNAVRSGTGYVGVFGAGTTLTVL

SEQ ID NO: 63 - DNA, 369 bp, artificial sequence
  heavy chain variable region of antibody clone #22
  CDS (1)..(369)
gcggtgacgttggacgagtccgggggcggcctccagacgcccggaggagcgctcagcctcgtctgcaaggcctccgggttcaccttcagcagtaatggcatggcctgggtgcgccaggcgcccggcaaggggctggaactcgtcgccagaattaacagtagtggtagttacacaaactacggggcggcggtgaagggccgtgccaccatctcgagggacaacgggcagagcacagtgaggctgcagctgaacaacctcagggctgaggacaccggcacctactactgcgccaaaggtgctagtggttatggtgcttatcctggtaacatcgacgcatggggccacgggaccgaagtcatcgtctcctcc

SEQ ID NO: 64 - protein, 123 aa, artificial sequence
  Synthetic Construct
AVTLDESGGGLQTPGGALSLVCKASGFTFSSNGMAWVRQAPGKGLELVARINSSGSYTNYGAAVKGRATISRDNGQSTVRLQLNNLRAEDTGTYYCAKGASGYGAYPGNIDAWGHGTEVIVSS

SEQ ID NO: 65 - DNA, 312 bp, artificial sequence
  light chain variable region of antibody clone #33
  CDS (1)..(312)
gctagcactcagccgtcctcggtgtcagcgaacccgggagaaaccgtcgagatcacctgctccggggatagtagctactatggctggttccagcagaagtctcctggcagtgcccctgtcactgtgatctatgacaacaccaacagaccctcggacatcccttcacgattctccggttccaagtccggctccacagccacattaaccatcactggggtccgagccgaggacgaggctgtctattactgtggtggctacgacagcagcacttatgatggtatatttggggccgggacaaccctgaccgtccta

SEQ ID NO: 66 - protein, 104 aa, artificial sequence
  Synthetic Construct
ASTQPSSVSANPGETVEITCSGDSSYYGWFQQKSPGSAPVTVIYDNTNRPSDIPSRFSGSKSGSTATLTITGVRAEDEAVYYCGGYDSSTYDGIFGAGTTLTVL

SEQ ID NO: 67 - DNA, 354 bp, artificial sequence
  heavy chain variable region of antibody clone #33
  CDS (1)..(354)
gcggtgacgttggacgagtccgggggcggcctccagacgcccggaggagggctcagcctcgtctgcaaggcctccgggttcaccttcagcagcttcaacatgaactgggtgcgacaggcgcctggcaaggggctggaatacgtcgctgaaattagcggcactggtagtagcacatactacgggtcggcggtgaagggccgtgccaccatctcgagggacaacgggcagagcacagtgaggctgcagctgaacaacctcagggctgaggacaccgccacctacttctgcgccagaggtgatggtgcttatagtatcgacgcatggggccacgggaccgaagtcatcgtctcctcc

SEQ ID NO: 68 - protein, 118 aa, artificial sequence
  Synthetic Construct
AVTLDESGGGLQTPGGGLSLVCKASGFTFSSFNMNWVRQAPGKGLEYVAEISGTGSSTYYGSAVKGRATISRDNGQSTVRLQLNNLRAEDTATYFCARGDGAYSIDAWGHGTEVIVSS

SEQ ID NO: 69 - DNA, 966 bp, artificial sequence
  FSTL1 used in Example (human)
  CDS (1)..(966)
atgtggaagagatggctggccctggctctggcactggtggctgtggcttgggtgcgcgccgaggaagaactgcggagcaagagcaagatctgcgccaacgtgttctgcggagccggcagagaatgtgccgtgaccgagaagggcgagcctacctgcctgtgcatcgagcagtgcaagccccacaagaggcctgtgtgcggcagcaacggcaagacctacctgaaccactgcgagctgcaccgggatgcctgtctgaccggcagcaagatccaggtggactacgacggccactgcaaagaaaagaaaagcgtgtcccccagcgccagccccgtcgtgtgttaccagagcaacagggacgagctgcggcggagaatcatccagtggctggaagccgagatcatccccgacggctggttcagcaagggcagcaactacagcgagatcctggacaagtacttcaagaacttcgacaacggcgacagcagactggacagcagcgagttcctgaagttcgtggaacagaacgagacagccatcaacatcaccacctaccccgaccaggaaaacaacaagctgctgcggggcctgtgcgtggacgccctgattgagctgagcgacgagaacgccgactggaagctgagctttcaggaatttctgaagtgcctgaaccccagcttcaacccccccgagaagaagtgcgccctggaggacgagacatacgccgatggcgccgagacagaggtggactgcaacagatgcgtgtgcgcctgcggcaactgggtgtgcaccgccatgacctgcgacggcaagaatcagaagggcgcccagacccagaccgaagaagagatgaccagatacgtgcaggaactgcagaagcaccaggaaaccgccgaaaagaccaagcgggtgtccaccaaagagatcgccgctgcccaccaccatcaccatcatcaccaccaccattga

SEQ ID NO: 70 - protein, 321 aa, artificial sequence
  Synthetic Construct
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEIAAAHHHHHHHHHH

SEQ ID NO: 71 - DNA, 960 bp, artificial sequence
  FSTL1 used in Example (mouse)
  CDS (1)..(960)
atgtggaagcggtggctggccctgagcctcgtgacaattgctctggtgcacggcgaggaagaacccagaagcaagagcaagatctgcgccaacgtgttctgcggagccggcagagaatgtgccgtgaccgagaagggcgagcctacctgcctgtgcatcgagcagtgcaagccccacaagaggcctgtgtgcggcagcaacggcaagacctacctgaaccactgcgagctgcaccgggatgcctgtctgaccggcagcaagatccaggtggactacgacggccactgcaaagagaagaagtccgccagccctagcgccagcccagtcgtgtgttaccaggccaaccgggacgagctgcggcggagactgattcagtggctggaagccgagatcatccccgacggctggttcagcaagggcagcaactacagcgagatcctggacaagtacttcaagagcttcgacaacggcgacagccacctggacagcagcgagttcctgaagttcgtggaacagaacgagacagccatcaacatcaccacctacgccgaccaggaaaacaacaagctgctgagaagcctgtgcgtggacgccctgatcgagctgagcgacgagaacgccgactggaagctgagctttcaggaatttctgaagtgcctgaaccccagcttcaacccccccgagaagaaatgcgccctggaagatgagacatacgccgacggcgccgagacagaggtggactgcaatagatgcgtgtgcagctgcggccactgggtgtgcaccgccatgacctgcgacggcaagaaccagaaaggcgtgcagacccacaccgaggaagagaaaaccggctacgtgcaggaactgcagaagcaccagggcaccgccgaaaagaccaagaaagtgaacaccaaagagatcgccgctgcccaccaccatcaccatcatcaccaccaccattga

SEQ ID NO: 72 - protein, 319 aa, artificial sequence
  Synthetic Construct
MWKRWLALSLVTIALVHGEEEPRSKSKICANVFCGAGRECAVTEKGEPTCLCIEQCKPHKRPVCGSNGKTYLNHCELHRDACLTGSKIQVDYDGHCKEKKSASPSASPVVCYQANRDELRRRLIQWLEAEIIPDGWFSKGSNYSEILDKYFKSFDNGDSHLDSSEFLKFVEQNETAINITTYADQENNKLLRSLCVDALIELSDENADWKLSFQEFLKCLNPSFNPPEKKCALEDETYADGAETEVDCNRCVCSCGHWVCTAMTCDGKNQKGVQTHTEEEKTGYVQELQKHQGTAEKTKKVNTKEIAAAHHHHHHHHHH

SEQ ID NO: 73 - DNA, 61 bp, artificial sequence
  MCS sequence
aagcttggatccactagtgaattcatctaccagctagcgtggcatctagacactctcgaga

SEQ ID NO: 74 - DNA, 61 bp, artificial sequence
  MCS sequence (complementary strand)
ctcgagagtgtctagatgccacgctagctggtagatgaattcactagtggatccaagctta

SEQ ID NO: 75 - DNA, 16 bp, artificial sequence
  insert sequence
cgaacccttaagcttg

SEQ ID NO: 76 - DNA, 15 bp, artificial sequence
  insert sequence
cgtggcatctagaca

SEQ ID NO: 77 - DNA, 25 bp, artificial sequence
  delta 21-53 (Forward primer)
tgcatcgagcagtgcaagccccaca

SEQ ID NO: 78 - DNA, 25 bp, artificial sequence
  delta 21-53 (Reverse primer)
ggcgcgcacccaagccacagccacc

SEQ ID NO: 79 - DNA, 25 bp, artificial sequence
  delta 100-140(Forward primer)
aagggcagcaactacagcgagatcc

SEQ ID NO: 80 - DNA, 25 bp, artificial sequence
  delta100-140( Reverse primer)
tttgcagtggccgtcgtagtccacc

SEQ ID NO: 81 - DNA, 25 bp, artificial sequence
  delta 148-170(Forward primer)
ttcgtggaacagaacgagacagcca

SEQ ID NO: 82 - DNA, 25 bp, artificial sequence
  delta 148-170( Reverse primer)
ctcgctgtagttgctgcccttgctg

SEQ ID NO: 83 - DNA, 25 bp, artificial sequence
  delta 181-190(Forward primer)
aagctgctgcggggcctgtgcgtgg

SEQ ID NO: 84 - DNA, 25 bp, artificial sequence
  delta 181-190( Reverse primer)
gttgatggctgtctcgttctgttcc

SEQ ID NO: 85 - DNA, 25 bp, artificial sequence
  delta 193-228(Forward primer)
cccgagaagaagtgcgccctggagg

SEQ ID NO: 86 - DNA, 25 bp, artificial sequence
  delta 193-228( Reverse primer)
cagcttgttgttttcctggtcgggg

SEQ ID NO: 87 - DNA, 25 bp, artificial sequence
  delta 233-289(Forward primer)
ctgcagaagcaccaggaaaccgccg

SEQ ID NO: 88 - DNA, 25 bp, artificial sequence
  delta 233-289( Reverse primer)
cttcttctcgggggggttgaagctg

SEQ ID NO: 89 - DNA, 26 bp, artificial sequence
  delta 148-154(Forward primer)
aacttcgacaacggcgacagcagact

SEQ ID NO: 90 - DNA, 25 bp, artificial sequence
  delta 148-154(Reverse primer)
ctcgctgtagttgctgcccttgctg

SEQ ID NO: 91 - DNA, 25 bp, artificial sequence
  delta 155-162(Forward primer)
ctggacagcagcgagttcctgaagt

SEQ ID NO: 92 - DNA, 25 bp, artificial sequence
  delta 155-162(Reverse primer)
cttgaagtacttgtccaggatctcg

SEQ ID NO: 93 - DNA, 25 bp, artificial sequence
  delta 163-170(Forward primer)
ttcgtggaacagaacgagacagcca

SEQ ID NO: 94 - DNA, 25 bp, artificial sequence
  delta 163-170(Reverse primer)
tctgctgtcgccgttgtcgaagttc

SEQ ID NO: 95 - DNA, 839 bp, artificial sequence
  full length light chain of antibody clone #5-2
  CDS (1)..(48)
  Intron (49)..(173)
  CDS (174)..(836)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttccaaatccggctccacagccacattaaccatcactggggtccaagccgaggacgaggctgtctatttctgtggtggctacgacagcagtactggtcatggtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 96 - protein, 237 aa, artificial sequence
  Synthetic Construct
MAWAPLLLAVLAHTSGSLVQAASTQPSSVSANPGEAVKITCSGGSGSYYGWYQQKSPGSAPVTVIYNNNQRPSDIPSRFSGSKSGSTATLTITGVQAEDEAVYFCGGYDSSTGHGGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 97 - DNA, 1629 bp, artificial sequence
  full length heavy chain of antibody clone #5-2
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccgggttcaccttcagcagcttcaacatgttctgggtgcgacaggctccaggcaaggggctggagtgggtcgctggtgttggcaaggatggtggtacaggatacggggcggcggtggatggccgtgccaccatctcaaaggacaacgggcagagcacactgaggctgcagctgaacaacctcagggctgaggacaccggcacctactactgcgccaaagctgctggtggttgtagttacggttggtgtggttcttatgttggtgatatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 98 - protein, 481 aa, artificial sequence
  Synthetic Construct
MSPLVSSLLLLAALPGLMAAVTLDESGGGLQTPGGGLSLVCKGSGFTFSSFNMFWVRQAPGKGLEWVAGVGKDGGTGYGAAVDGRATISKDNGQSTLRLQLNNLRAEDTGTYYCAKAAGGCSYGWCGSYVGDIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 99 - DNA, 833 bp, artificial sequence
  full length light chain of antibody clone #5-3
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagatcacctgctccgggggtagtggctactactatggctggtatcagcagaagtctcctggcagtgtccctgtcactgtgatctataacaacaacaacagaccctcggacatcccgtcacgattctccggttccaaatccggctccacaggcacattaaccatcactggggtccgagccgaggacgaggctgtctattattgtggaggctacgacaacagcggtactggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 100 - protein, 235 aa, artificial sequence
  Synthetic Construct
MAWAPLLLAVLAHTSGSLVQAASTQPSSVSANPGETVKITCSGGSGYYYGWYQQKSPGSVPVTVIYNNNNRPSDIPSRFSGSKSGSTGTLTITGVRAEDEAVYYCGGYDNSGTGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 101 - DNA, 1629 bp, artificial sequence
  full length heavy chain of antibody clone #5-3
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaagggctccgggttctccttcagcagcttcaacatgttctgggtgcgccaggcgcccggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 102 - protein, 481 aa, artificial sequence
  Synthetic Construct
MSPLVSSLLLLAALPGLMAAVTLDESGGGLQTPGGALSLVCKGSGFSFSSFNMFWVRQAPGKGLEWVAGIGKDGVPKYGAAVDGRATISKDNGQSTMRLQLNNLRAEDTGTYFCAKAAGGCSYDWCGIYAGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 103 - DNA, 839 bp, artificial sequence; identical to SEQ ID NO: 95
  full length light chain of antibody clone #5-8
  CDS (1)..(48)
  Intron (49)..(173)
  CDS (174)..(836)

SEQ ID NO: 104 - protein, 237 aa, artificial sequence; identical to SEQ ID NO: 96
  Synthetic Construct

SEQ ID NO: 105 - DNA, 1629 bp, artificial sequence
  full length heavy chain of antibody clone #5-8
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccgggttcaccttcagcagtttcaacatgttctgggtgcgacaggctccaggcaaggggctggagtgggtcgctggtataggcaaggatggtgttccaaaatacgggacggcggtggatggccgcgccaccatctcgaaggacaacgggcagagcacaatgaggctgcagctgaacaacctcagggctgaggacaccggcacctacttctgcgccaaagctgctggtggttgtagttacgattggtgtggtatttatactggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 106 - protein, 481 aa, artificial sequence
  Synthetic Construct
MSPLVSSLLLLAALPGLMAAVTLDESGGGLQTPGGGLSLVCKGSGFTFSSFNMFWVRQAPGKGLEWVAGIGKDGVPKYGTAVDGRATISKDNGQSTMRLQLNNLRAEDTGTYFCAKAAGGCSYDWCGIYTGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 107 - DNA, 845 bp, artificial sequence
  full length light chain of antibody clone #5-10
  CDS (1)..(48)
  Intron (49)..(173)
  CDS (174)..(842)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagatcacctgctccgggggtggcagctatgttggaagttactattatggctggtatcagcagaagtctcctggcagtgcccctgtcactgtgatctataacaacaaccagagaccctcggacatcccttcacgattctccggttctaaatccggctccacggccacattaaccatcactggggtccaagccgaggacgaggctgtctatttctgtggtggctacgacagcagtgctggtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 108 - protein, 239 aa, artificial sequence
  Synthetic Construct
MAWAPLLLAVLAHTSGSLVQAASTQPSSVSANPGETVKITCSGGGSYVGSYYYGWYQQKSPGSAPVTVIYNNNQRPSDIPSRFSGSKSGSTATLTITGVQAEDEAVYFCGGYDSSAGGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 109 - DNA, 1629 bp, artificial sequence
  full length heavy chain of antibody clone #5-10
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccgggttcaccctcagtagcttcaacatgttctgggtgcgacaggcgcccggcaagggactggaatgggtcgctggtgttggcaaggatggtggtacaacttatggggcggcggtggatggccgtgccaccatctcgagggacagcgggcagagtacagtgaggctgcagctgaacgacctcagggctgaggacaccggcacctacttctgcgccaaagctgctggtggttgtagttacagttggtgtggtgcttatgttggtgatctcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 110 - protein, 481 aa, artificial sequence
  Synthetic Construct
MSPLVSSLLLLAALPGLMAAVTLDESGGGLQTPGGGLSLVCKGSGFTLSSFNMFWVRQAPGKGLEWVAGVGKDGGTTYGAAVDGRATISRDSGQSTVRLQLNDLRAEDTGTYFCAKAAGGCSYSWCGAYVGDLDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 111 - DNA, 839 bp, artificial sequence; identical to SEQ ID NO: 95
  full length light chain of antibody clone #5-43
  CDS (1)..(48)
  Intron (49)..(173)
  CDS (174)..(836)

SEQ ID NO: 112 - protein, 237 aa, artificial sequence; identical to SEQ ID NO: 96
  Synthetic Construct

SEQ ID NO: 113 - DNA, 1629 bp, artificial sequence
  full length heavy chain of antibody clone #5-43
  CDS (1)..(45)
  insert (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccggcttcaccttcagcagcttcaacatgttctgggtgcgacaggctccaggcaaggggctggagtgggtcgctggtattggcaaggatggtggtacaggatacggggcggcggtggatggccgtgccaccatctcgaaggacagcgggcagagcactctgaggctgcagctgaacaacctcagggctgaggacaccggcacctactactgcgccaaagctgctggtggttgtagttacgattggtgtggtgcttatactggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 114 - protein, 481 aa, artificial sequence
  Synthetic Construct
MSPLVSSLLLLAALPGLMAAVTLDESGGGLQTPGGGLSLVCKGSGFTFSSFNMFWVRQAPGKGLEWVAGIGKDGGTGYGAAVDGRATISKDSGQSTLRLQLNNLRAEDTGTYYCAKAAGGCSYDWCGAYTGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 115 - DNA, 833 bp, artificial sequence
  full length light chain of antibody clone #6-55
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaatcccaggagaaaccgtcaagatcacctgctccgggggtggcaacaactatggctggtaccagcagaggtctcctggcagtgcccctgtcactgtgatctattacaacgacaacagaccctcgaacatcccttcacgattctccggttccacatccggctccacaagcacattaaccatcactggggtccaagccgacgacgaggctatctattactgtgggagctgggatagcaacactgatagtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 116 - protein, 235 aa, artificial sequence
  Synthetic Construct
MAWAPLLLAVLAHTSGSLVQAASTQPSSVSAIPGETVKITCSGGGNNYGWYQQRSPGSAPVTVIYYNDNRPSNIPSRFSGSTSGSTSTLTITGVQADDEAIYYCGSWDSNTDSGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 117 - DNA, 1626 bp, artificial sequence
  full length heavy chain of antibody clone #6-55
  CDS (1)..(45)
  Intron (46)..(228)
  CDS (229)..(1623)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaagggctccgggttcaccttcaccagcgtcaccatgcagtgggtgcgacaggcgcccggcaaggggctcgaatgggtcgctagtgtctgcagtggtagttccacatattacgcgccggcggtgaagggccgtgccaccatctcgagggacaacgggcagagcacagtgaggctgcagctgagcaacctcaggcctgaggacaccggcacgtactactgcgccaaaattgctggtcgtgctaggtggagttgtacaagtgctgcttacaacatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 118 - protein, 480 aa, artificial sequence
  Synthetic Construct
MSPLVSSLLLLAALPGLMAAVTLDESGGGLQTPGGALSLVCKGSGFTFTSVTMQWVRQAPGKGLEWVASVCSGSSTYYAPAVKGRATISRDNGQSTVRLQLSNLRPEDTGTYYCAKIAGRARWSCTSAAYNIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 119 - DNA, 833 bp, artificial sequence
  full length light chain of antibody clone #7-34
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagatcacctgctccgggggtggcaacaactatggctggtaccagcagaagtctcctggcagtgcccctgtcactgtgatctattacaacaacaacagaccctcgaacatcccttcacgattctccggttccacatccggctccacaagcacattaaccatcactggggtccaagccgaggacgaggctgtctattattgtgggagctacgaaggcagtactgatagtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 120 - protein, 235 aa, artificial sequence
  Synthetic Construct
MAWAPLLLAVLAHTSGSLVQAASTQPSSVSANPGETVKITCSGGGNNYGWYQQKSPGSAPVTVIYYNNNRPSNIPSRFSGSTSGSTSTLTITGVQAEDEAVYYCGSYEGSTDSGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 121 - DNA, 1626 bp, artificial sequence
  full length heavy chain of antibody clone #7-34
  CDS (1)..(45)
  Intron (46)..(228)
  CDS (229)..(1623)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaaggcctccgggttcaccttcagcagcgtcaccatgcagtgggtgcgacaggcgcccggcaaggggctcgaatgggtcgctagtatttgtagtggtagtagcacatactacgggccggcggtgaagggccgtgccaccatctcgagggacaacgggcagaacacagtgaggctgcagctgaacaacctcagggctgaggacaccgccacctactactgcgccaaaattgttggtcgtggtaggtggagttgtactagtgctgcttataacatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 122 - protein, 480 aa, artificial sequence
  Synthetic Construct
MSPLVSSLLLLAALPGLMAAVTLDESGGGLQTPGGGLSLVCKASGFTFSSVTMQWVRQAPGKGLEWVASICSGSSTYYGPAVKGRATISRDNGQNTVRLQLNNLRAEDTATYYCAKIVGRGRWSCTSAAYNIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 123 - DNA, 839 bp, artificial sequence
  full length light chain of antibody clone #8-1
  CDS (1)..(48)
  Intron (49)..(173)
  CDS (174)..(836)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttccaaatccggctccacagccacattaaccatcactggggtccaagccgaggacgaggctgtctatttctgtggtggctacgacagcagtagtggtcatggtggtatattcggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 124 - protein, 237 aa, artificial sequence
  Synthetic Construct
MAWAPLLLAVLAHTSGSLVQAASTQPSSVSANPGEAVKITCSGGSGSYYGWYQQKSPGSAPVTVIYNNNQRPSDIPSRFSGSKSGSTATLTITGVQAEDEAVYFCGGYDSSSGHGGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 125 - DNA, 1629 bp, artificial sequence
  full length heavy chain of antibody clone #8-1
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaagggctccgggttcaccttcagcagcttcaacatgttctgggtgcgacaggctccaggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 126 - protein, 481 aa, artificial sequence
  Synthetic Construct
MSPLVSSLLLLAALPGLMAAVTLDESGGGLQTPGGALSLVCKGSGFTFSSFNMFWVRQAPGKGLEWVAGIGKDGVPKYGAAVDGRATISKDNGQSTMRLQLNNLRAEDTGTYFCAKAAGGCSYDWCGIYAGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 127 - DNA, 833 bp, artificial sequence
  full length light chain of antibody clone #8-4
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcagtcagccgtcctcggtgtcagcaaacccaggagaaaccgtcaagatcacctgctccgggggtagtggctactactatggctggtatcagcagaagtctcctggcagtgcccctgtcactgtgatctataacaacgacaacaaaccctcagacatcccttcacgattctccggttccaaatccggctccacaggcacattaaccatcactggggtccaagtcgaggacgaggctgtctatttctgtggaggctacgacaacagcggtactggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 128 - protein, 235 aa, artificial sequence
  Synthetic Construct
MAWAPLLLAVLAHTSGSLVQAASSQPSSVSANPGETVKITCSGGSGYYYGWYQQKSPGSAPVTVIYNNDNKPSDIPSRFSGSKSGSTGTLTITGVQVEDEAVYFCGGYDNSGTGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 129 - DNA, 1629 bp, artificial sequence
  full length heavy chain of antibody clone #8-4
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccgggttcaccctcagtagcttcaacatgttctgggtgcgacaggcgcccggcaagggactggaatgggtcgctggtgttggcaaggatggtggtacagcttatggggcggcggtggatggccgtgccaccatctcgagggacagcgggcagagcacagtgaggctgcagctgaacaacctcagggctgaggacaccggcacctacttctgcgccaaagctgctggtggttgtagttacagttggtgtggtgcttatgttggtgatctcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 130 - protein, 481 aa, artificial sequence
  Synthetic Construct
MSPLVSSLLLLAALPGLMAAVTLDESGGGLQTPGGGLSLVCKGSGFTLSSFNMFWVRQAPGKGLEWVAGVGKDGGTAYGAAVDGRATISRDSGQSTVRLQLNNLRAEDTGTYFCAKAAGGCSYSWCGAYVGDLDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 131 - DNA, 839 bp, artificial sequence; identical to SEQ ID NO: 95
  full length light chain of antibody clone #8-7
  CDS (1)..(48)
  Intron (49)..(173)
  CDS (174)..(836)

SEQ ID NO: 132 - protein, 237 aa, artificial sequence; identical to SEQ ID NO: 96
  Synthetic Construct

SEQ ID NO: 133 - DNA, 1629 bp, artificial sequence
  full length heavy chain of antibody clone #8-7
  CDS (1)..(45)
  Intron (46)..(173)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaagggctccgggttcaccttcagcagtttcaacatgttctgggtgcgacaggctccaggcaaggggctggaatgggtcgctggcataggcaaggatggtgttcctaaatacggggcggcggtggacggccgtgccaccatctcgaaggacaacgggcagagcacactgaggctgcagctgaacaacctcagggctgaggacaccggcacctacttctgcgccaaagctgctggtggttgtagttacgattggtgtggtatttatgctggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 134 - protein, 481 aa, artificial sequence
  Synthetic Construct
MSPLVSSLLLLAALPGLMAAVTLDESGGGLQTPGGGLSLVCKGSGFTFSSFNMFWVRQAPGKGLEWVAGIGKDGVPKYGAAVDGRATISKDNGQSTLRLQLNNLRAEDTGTYFCAKAAGGCSYDWCGIYAGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 135 - DNA, 839 bp, artificial sequence
  full length light chain of antibody clone #8-8
  CDS (1)..(48)
  Intron (49)..(173)
  CDS (174)..(836)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaagccgtcaagatcacctgctccgggggtagtggcagctactacggctggtatcagcagaagtctcctggcagtgcccctgtcactgtgatctataacaacaaccagagaccctcggacatcccttcacgattctccggttctaaatccggctccacggccacattaaccatcactggggtccaagtcgaggacgaggctgtctatttctgtggtggctacgacagcagtactggtcatggtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 136 - protein, 237 aa, artificial sequence
  Synthetic Construct
MAWAPLLLAVLAHTSGSLVQAASTQPSSVSANPGEAVKITCSGGSGSYYGWYQQKSPGSAPVTVIYNNNQRPSDIPSRFSGSKSGSTATLTITGVQVEDEAVYFCGGYDSSTGHGGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 137 - DNA, 1629 bp, artificial sequence
  full length heavy chain of antibody clone #8-8
  CDS (1)..(45)
  Intron (46)..(228)
  CDS (229)..(1626)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaagggctccgggttcaccttcagcagcttcaacatgttctgggtgcgacaggctccaggcaaggggctggagtgggtcgctggtataggcaaggatggtgttccaaaatacggggcggcggtggatggccgtgccaccatctcgaaggacaacgggcagagcacaatgaggctgcagctgaacaacctcagggctgaggacaccggcacctactactgcgccaaagctgctggtggttgtagttacggttggtgtggtgcttatactggtgacatcgacacatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 138 - protein, 481 aa, artificial sequence
  Synthetic Construct
MSPLVSSLLLLAALPGLMAAVTLDESGGGLQTPGGALSLVCKGSGFTFSSFNMFWVRQAPGKGLEWVAGIGKDGVPKYGAAVDGRATISKDNGQSTMRLQLNNLRAEDTGTYYCAKAAGGCSYGWCGAYTGDIDTWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 139 - DNA, 830 bp, artificial sequence
  full length light chain of antibody clone #7
  CDS (1)..(48)
  Intron (49)..(173)
  CDS (174)..(827)
  misc_feature (228)..(228): n is a, c, g, or t
  misc_feature (232)..(233): n is a, c, g, or t
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccagganaaanngtcaagatcacctgctccgggggtggtagcagatatggctggtatcagcagaagtctcctggcagtgcccctgtcactgtgatctattacaacgacaagagaccctcgaacatcccttcacgattctccggttcgaaatccggctccacaggcacattaaccatcactggggtccgagccgaggacgaggctgtctatttctgtggtggctacgacggcagcactgatgctgcatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 140 - protein, 234 aa, artificial sequence
  misc_feature (35)..(35): The 'Xaa' at location 35 stands for Lys, Glu, or Gln.
  misc_feature (36)..(36): The 'Xaa' at location 36 stands for Lys, Asn, Arg, Ser, Thr, Ile, or Met.
  Synthetic Construct
MAWAPLLLAVLAHTSGSLVQAASTQPSSVSANPGXXVKITCSGGGSRYGWYQQKSPGSAPVTVIYYNDKRPSNIPSRFSGSKSGSTGTLTITGVRAEDEAVYFCGGYDGSTDAAFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 141 - DNA, 1638 bp, artificial sequence
  full length heavy chain of antibody clone #7
  CDS (1)..(45)
  Intron (49)..(228)
  CDS (229)..(1635)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaaggcctccgggtttttcttctttagcatttatgacatgggttgggtgcgacaggcgcctggcaaagggctggaatgggtcgctggtattgatgattatggtgaatacacaggctacgggtcggcggtgaagggccgtgccaccatctcgagggacaacgggcagagcacagtgaggctgcagctgaacaacctcagggctgaggacaccggcacctactactgcgccagaggtgctggtacgggttgtaatagtgctggttgtggtgcttatgctggcagcatcgacgcatggggccacgggaccgaagtcatcgtctctccggctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 142 - protein, 484 aa, artificial sequence
  Synthetic Construct
MSPLVSSLLLLAALPGLMAAVTLDESGGGLQTPGGALSLVCKASGFFFFSIYDMGWVRQAPGKGLEWVAGIDDYGEYTGYGSAVKGRATISRDNGQSTVRLQLNNLRAEDTGTYYCARGAGTGCNSAGCGAYAGSIDAWGHGTEVIVSPASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 143 - DNA, 833 bp, artificial sequence
  full length light chain of antibody clone #10
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagctcacctgctccgggggtggcagcaggtatggctggtatcagcagaagtcacctggcagtgcccctgtcactgtgatctattacaacgacaagagaccctcggacatcccttcacgattctccggttccaaatccggctccacggccacattaaccatcactggggtccaagccgaggacgaggctgtctatttctgtggtggctacgacggcagcagagatgctggtatatttggggccgggacaaccctgaccgtactaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 144 - protein, 235 aa, artificial sequence
  Synthetic Construct
MAWAPLLLAVLAHTSGSLVQAASTQPSSVSANPGETVKLTCSGGGSRYGWYQQKSPGSAPVTVIYYNDKRPSDIPSRFSGSKSGSTATLTITGVQAEDEAVYFCGGYDGSRDAGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 145 - DNA, 1638 bp, artificial sequence
  full length heavy chain of antibody clone #10
  CDS (1)..(45)
  Intron (46)..(228)
  CDS (229)..(1635)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaaggcctccgggtttttcttctttaggatttatgacatgggttgggtgcgacaggcgcctggcaaagggctggaatgggtcgctggtattgatgattatggtagatacacaggctacgggtcggcggtgaagggccgtgccaccatctcgagggacaacgggcagagcacagtgaggctgcaactgaacaacctcagggctgaggacaccggcacctactactgcgccagaggtgctggtacgggttgtaatagtgctggttgtggtgcttatgctggtagcatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 146 - protein, 484 aa, artificial sequence
  Synthetic Construct
MSPLVSSLLLLAALPGLMAAVTLDESGGGLQTPGGALSLVCKASGFFFFRIYDMGWVRQAPGKGLEWVAGIDDYGRYTGYGSAVKGRATISRDNGQSTVRLQLNNLRAEDTGTYYCARGAGTGCNSAGCGAYAGSIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 147 - DNA, 833 bp, artificial sequence
  full length light chain of antibody clone #13
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagatcacctgctccgggggtggcaacaactatggctggtatcagcagaagtctcctggcagtgcccctgtcactgtgatctataacaacaacaacagaccctcgaacatcccttcacgattctccggttccaaatccggctccacaaacacattaaccatcactggggtccaagccgaggacgaggctgtctattactgtgggagctacgacagcagcagtgatagtggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 148 - protein, 235 aa, artificial sequence
  Synthetic Construct
MAWAPLLLAVLAHTSGSLVQAASTQPSSVSANPGETVKITCSGGGNNYGWYQQKSPGSAPVTVIYNNNNRPSNIPSRFSGSKSGSTNTLTITGVQAEDEAVYYCGSYDSSSDSGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 149 - DNA, 1626 bp, artificial sequence; identical to SEQ ID NO: 121
  full length heavy chain of antibody clone #13
  CDS (1)..(45)
  Intron (46)..(228)
  CDS (229)..(1623)

SEQ ID NO: 150 - protein, 480 aa, artificial sequence; identical to SEQ ID NO: 122
  Synthetic Construct

SEQ ID NO: 151 - DNA, 839 bp, artificial sequence
  full length light chain of antibody clone #22
  CDS (1)..(48)
  Intron (49)..(173)
  CDS (174)..(836)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcaaacccaggagaaaccgtcaagatcacctgctccgggggtagtggcagctatggctggttccagcagaagtctcctggcagtgcccctgtcactgtgatctactgggatgacaggagaccctcagacatcccttcacgattctccggttccaaatccggctccatacacacattaaccatcactggggtccaagccgacgacgaggctgtctatctctgtgggaatgcagtcaggagcggtacgggttatgttggtgtgtttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 152 - protein, 237 aa, artificial sequence
  Synthetic Construct
MAWAPLLLAVLAHTSGSLVQAASTQPSSVSANPGETVKITCSGGSGSYGWFQQKSPGSAPVTVIYWDDRRPSDIPSRFSGSKSGSIHTLTITGVQADDEAVYLCGNAVRSGTGYVGVFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 153 - DNA, 1617 bp, artificial sequence
  full length heavy chain of antibody clone #22
  CDS (1)..(45)
  Intron (46)..(228)
  CDS (229)..(1614)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagcgctcagcctcgtctgcaaggcctccgggttcaccttcagcagtaatggcatggcctgggtgcgccaggcgcccggcaaggggctggaactcgtcgccagaattaacagtagtggtagttacacaaactacggggcggcggtgaagggccgtgccaccatctcgagggacaacgggcagagcacagtgaggctgcagctgaacaacctcagggctgaggacaccggcacctactactgcgccaaaggtgctagtggttatggtgcttatcctggtaacatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 154 - protein, 477 aa, artificial sequence
  Synthetic Construct
MSPLVSSLLLLAALPGLMAAVTLDESGGGLQTPGGALSLVCKASGFTFSSNGMAWVRQAPGKGLELVARINSSGSYTNYGAAVKGRATISRDNGQSTVRLQLNNLRAEDTGTYYCAKGASGYGAYPGNIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 155 - DNA, 833 bp, artificial sequence
  full length light chain of antibody clone #33
  CDS (1)..(48)
  Intron (49)..(173)
  CDS (174)..(830)
atggcctgggctcctctcctcctggcggtgctcgcccacacctcaggtactcgttgcgcccggtcggggactgtgggcacggggctctgtcccactgctgcgcgggcagggctgtgtgtgcggggccgtcactgattgtcgttttctcccctctctcctctccctctccaggttccctggtgcaggcagctagcactcagccgtcctcggtgtcagcgaacccgggagaaaccgtcgagatcacctgctccggggatagtagctactatggctggttccagcagaagtctcctggcagtgcccctgtcactgtgatctatgacaacaccaacagaccctcggacatcccttcacgattctccggttccaagtccggctccacagccacattaaccatcactggggtccgagccgaggacgaggctgtctattactgtggtggctacgacagcagcacttatgatggtatatttggggccgggacaaccctgaccgtcctaggccagccgcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 156 - protein, 235 aa, artificial sequence
  Synthetic Construct
MAWAPLLLAVLAHTSGSLVQAASTQPSSVSANPGETVEITCSGDSSYYGWFQQKSPGSAPVTVIYDNTNRPSDIPSRFSGSKSGSTATLTITGVRAEDEAVYYCGGYDSSTYDGIFGAGTTLTVLGQPRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 157 - DNA, 1602 bp, artificial sequence
  full length heavy chain of antibody clone #33
  CDS (1)..(45)
  Intron (46)..(228)
  CDS (229)..(1599)
atgagcccactcgtctcctccctcctgctcctggccgccctgccaggtgagggcgctgtggggctctatggggctctatggggtctcagcggggctctgcgggctcaatgggggccaaagggggggtctgcgggctctatgggggggtcaacggggggtctcacggggggccggctccgcgaggccgtgtggcggcggctccgtcagcgctttctgtccttccccacagggctgatggccgcggtgacgttggacgagtccgggggcggcctccagacgcccggaggagggctcagcctcgtctgcaaggcctccgggttcaccttcagcagcttcaacatgaactgggtgcgacaggcgcctggcaaggggctggaatacgtcgctgaaattagcggcactggtagtagcacatactacgggtcggcggtgaagggccgtgccaccatctcgagggacaacgggcagagcacagtgaggctgcagctgaacaacctcagggctgaggacaccgccacctacttctgcgccagaggtgatggtgcttatagtatcgacgcatggggccacgggaccgaagtcatcgtctcctccgctagcgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggaaaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatcaaccggtcatcatcaccatcaccattga

SEQ ID NO: 158 - protein, 472 aa, artificial sequence
  Synthetic Construct
MSPLVSSLLLLAALPGLMAAVTLDESGGGLQTPGGGLSLVCKASGFTFSSFNMNWVRQAPGKGLEYVAEISGTGSSTYYGSAVKGRATISRDNGQSTVRLQLNNLRAEDTATYFCARGDGAYSIDAWGHGTEVIVSSASAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKSTGHHHHHH

SEQ ID NO: 159 - protein, 290 aa, artificial sequence
  FSTL1 from Novoprotein
MAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 160 - DNA, 90 bp, artificial sequence
  humanaizedH1-FR1
  CDS (1)..(90)
gaggtgcagctgttggagtctgggggaggactggtgcagcctggcggaagcctgagactgtcttgtgccgccagcggcttcaccttcagc

SEQ ID NO: 161 - protein, 30 aa, artificial sequence
  Synthetic Construct
EVQLLESGGGLVQPGGSLRLSCAASGFTFS

SEQ ID NO: 162 - DNA, 42 bp, artificial sequence
  humanaizedH1-FR2
  CDS (1)..(42)
tgggtgcgccaggcccctggcaagggactggaatttgtggcc

SEQ ID NO: 163 - protein, 14 aa, artificial sequence
  Synthetic Construct
WVRQAPGKGLEFVA

SEQ ID NO: 164 - DNA, 96 bp, artificial sequence
  humanaizedH1-FR3
  CDS (1)..(96)
cggttcaccatctcccgggacaacagcaagaacaccctgtacctgcagatgaacagcctgcgggccgaggacaccgccgtgtactactgtgccaag

SEQ ID NO: 165 - protein, 32 aa, artificial sequence
  Synthetic Construct
RFTISRDNSKNTLYLQMNSLRAEDTAVYYCAK

SEQ ID NO: 166 - DNA, 33 bp, artificial sequence
  humanaizedH1-FR4
  CDS (1)..(33)
tggggacagggaaccctggtcaccgtctcctca

SEQ ID NO: 167 - protein, 11 aa, artificial sequence
  Synthetic Construct
WGQGTLVTVSS

SEQ ID NO: 168 - DNA, 90 bp, artificial sequence; identical to SEQ ID NO: 160
  humanaizedH2-FR1
  CDS (1)..(90)

SEQ ID NO: 169 - protein, 30 aa, artificial sequence; identical to SEQ ID NO: 161
  Synthetic Construct

SEQ ID NO: 170 - DNA, 42 bp, artificial sequence
  humanaizedH2-FR2
  CDS (1)..(42)
tgggtgcgccaggcccctggcaagggactggaatttgtgtcc

SEQ ID NO: 171 - protein, 14 aa, artificial sequence
  Synthetic Construct
WVRQAPGKGLEFVS

SEQ ID NO: 172 - DNA, 96 bp, artificial sequence
  humanaizedH2-FR3
  CDS (1)..(96)
cggttcaccatctcccgggacaacagcaagaacaccgtgtacctgcagatgaacagcctgcgggccgaggacaccgccgtgtactactgtgccaag

SEQ ID NO: 173 - protein, 32 aa, artificial sequence
  Synthetic Construct
RFTISRDNSKNTVYLQMNSLRAEDTAVYYCAK

SEQ ID NO: 174 - DNA, 33 bp, artificial sequence
  humanaizedH2-FR4
  CDS (1)..(33)
tggggacagggaaccctcgtgacagtgtctagc

SEQ ID NO: 175 - protein, 11 aa, artificial sequence
  Synthetic Construct
WGQGTLVTVSS

SEQ ID NO: 176 - DNA, 90 bp, artificial sequence; identical to SEQ ID NO: 160
  humanaizedH3-FR1
  CDS (1)..(90)

SEQ ID NO: 177 - protein, 30 aa, artificial sequence; identical to SEQ ID NO: 161
  Synthetic Construct

SEQ ID NO: 178 - DNA, 42 bp, artificial sequence; identical to SEQ ID NO: 162
  humanaizedH3-FR2
  CDS (1)..(42)

SEQ ID NO: 179 - protein, 14 aa, artificial sequence
  Synthetic Construct
WVRQAPGKGLEFVA

SEQ ID NO: 180 - DNA, 96 bp, artificial sequence
  humanaizedH3-FR3
  CDS (1)..(96)
agagtgaccatcagccgggacaacagcaagaacaccgtgtacctgcagatgaacagcctgcgggccgaggacaccgccgtgtactactgtgccaag

SEQ ID NO: 181 - protein, 32 aa, artificial sequence
  Synthetic Construct
RVTISRDNSKNTVYLQMNSLRAEDTAVYYCAK

SEQ ID NO: 182 - DNA, 33 bp, artificial sequence; identical to SEQ ID NO: 166
  humanaizedH3-FR4
  CDS (1)..(33)

SEQ ID NO: 183 - protein, 11 aa, artificial sequence
  Synthetic Construct
WGQGTLVTVSS

SEQ ID NO: 184 - DNA, 66 bp, artificial sequence
  humanaizedL1-FR1
  CDS (1)..(66)
agctatgagctgactcagccacccagcgtgtccgtgtctcctggccagaccgccagaatcacctgt

SEQ ID NO: 185 - protein, 22 aa, artificial sequence
  Synthetic Construct
SYELTQPPSVSVSPGQTARITC

SEQ ID NO: 186 - DNA, 45 bp, artificial sequence
  humanaizedL1-FR2
  CDS (1)..(45)
tggtatcagcagaagcccggccaggcccctgtgaccgtgatctac

SEQ ID NO: 187 - protein, 15 aa, artificial sequence
  Synthetic Construct
WYQQKPGQAPVTVIY

SEQ ID NO: 188 - DNA, 96 bp, artificial sequence
  humanaizedL1-FR3
  CDS (1)..(96)
ggcatccccgagagattcagcggcagcaatagcggctccaccaccaccctgacaatcagcggagtgcaggccgaggacgaggccgattactactgc

SEQ ID NO: 189 - protein, 32 aa, artificial sequence
  Synthetic Construct
GIPERFSGSNSGSTTTLTISGVQAEDEADYYC

SEQ ID NO: 190 - DNA, 30 bp, artificial sequence
  humanaizedL1-FR4
  CDS (1)..(30)
tttggcggcggaaccaagctgaccgtcctg

SEQ ID NO: 191 - protein, 10 aa, artificial sequence
  Synthetic Construct
FGGGTKLTVL

SEQ ID NO: 192 - DNA, 1425 bp, artificial sequence
  humanized-IgG1-H1-complete
  CDS (1)..(1425)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtggccagcgtgtgcagcggcagcagcacctattatgcccctgccgtgaagggccggttcaccatctcccgggacaacagcaagaacaccctgtacctgcagatgaacagcctgcgggccgaggacaccgccgtgtactactgtgccaagatcgccggcagagcccggtggtcttgtaccagcgccgcctacaacatcgacgcctggggacagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 193 - protein, 474 aa, artificial sequence
  Synthetic Construct
MSPLVSSLLLLAALPGRAEVQLLESGGGLVQPGGSLRLSCAASGFTFSSVTMQWVRQAPGKGLEFVASVCSGSSTYYAPAVKGRFTISRDNSKNTLYLQMNSLRAEDTAVYYCAKIAGRARWSCTSAAYNIDAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - DNA, 1425 bp, artificial sequence
  humanized-IgG1-H2-complete
  CDS (1)..(1425)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtgtccagcgtgtgcagcggcagcagcacctattatgcccctgccgtgaagggccggttcaccatctcccgggacaacagcaagaacaccgtgtacctgcagatgaacagcctgcgggccgaggacaccgccgtgtactactgtgccaagatcgccggcagagcccggtggtcttgtaccagcgccgcctacaacatcgacgcctggggacagggaaccctcgtgacagtgtctagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 195 - protein, 474 aa, artificial sequence
  Synthetic Construct
MSPLVSSLLLLAALPGRAEVQLLESGGGLVQPGGSLRLSCAASGFTFSSVTMQWVRQAPGKGLEFVSSVCSGSSTYYAPAVKGRFTISRDNSKNTVYLQMNSLRAEDTAVYYCAKIAGRARWSCTSAAYNIDAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - DNA, 1425 bp, artificial sequence
  humanized-IgG1-H3-complete
  CDS (1)..(1425)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtggccagcgtgtgcagcggcagcagcacctattatgcccctgccgtgaagggcagagtgaccatcagccgggacaacagcaagaacaccgtgtacctgcagatgaacagcctgcgggccgaggacaccgccgtgtactactgtgccaagatcgccggcagagcccggtggtcttgtaccagcgccgcctacaacatcgacgcctggggacagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 197 - protein, 474 aa, artificial sequence
  Synthetic Construct
MSPLVSSLLLLAALPGRAEVQLLESGGGLVQPGGSLRLSCAASGFTFSSVTMQWVRQAPGKGLEFVASVCSGSSTYYAPAVKGRVTISRDNSKNTVYLQMNSLRAEDTAVYYCAKIAGRARWSCTSAAYNIDAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 1416 bp, artificial sequence
  humanized-IgG4-H1-complete
  CDS (1)..(1416)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtggccagcgtgtgcagcggcagcagcacctattatgcccctgccgtgaagggccggttcaccatctcccgggacaacagcaagaacaccctgtacctgcagatgaacagcctgcgggccgaggacaccgccgtgtactactgtgccaagatcgccggcagagcccggtggtcttgtaccagcgccgcctacaacatcgacgcctggggacagggaaccctggtcaccgtctcctcagccagcaccaagggccccagcgtgttccctctggccccttgtagcagaagcaccagcgagtctacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgactgtgcccagcagctctctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcctagagaggaacagttcaacagcacctaccgggtggtgtccgtgctgacagtgctgcatcaggactggctgaacggcaaagagtacaagtgcaaggtgtccaacaagggcctgcccagctccatcgagaaaaccatcagcaaggccaagggccagccccgcgaaccccaggtgtacacactgcctccaagccaggaagagatgaccaagaaccaggtgtccctgacctgtctcgtgaaaggcttctacccctccgatatcgccgtggaatgggagagcaacggccagcccgagaacaactacaagacaaccccccctgtgctggacagcgacggctcattcttcctgtacagcagactgaccgtggacaagagccggtggcaggaaggcaacgtgttcagctgcagcgtgatgcacgaggccctgcacaaccactacacccagaagtccctgtctctgagcctgggcaagtga

SEQ ID NO: 199 - protein, 471 aa, artificial sequence
  Synthetic Construct
MSPLVSSLLLLAALPGRAEVQLLESGGGLVQPGGSLRLSCAASGFTFSSVTMQWVRQAPGKGLEFVASVCSGSSTYYAPAVKGRFTISRDNSKNTLYLQMNSLRAEDTAVYYCAKIAGRARWSCTSAAYNIDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 200 - DNA, 1416 bp, artificial sequence
  humanized-IgG4-H2-complete
  CDS (1)..(1416)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtgtccagcgtgtgcagcggcagcagcacctattatgcccctgccgtgaagggccggttcaccatctcccgggacaacagcaagaacaccgtgtacctgcagatgaacagcctgcgggccgaggacaccgccgtgtactactgtgccaagatcgccggcagagcccggtggtcttgtaccagcgccgcctacaacatcgacgcctggggacagggaaccctcgtgacagtgtctagcgccagcaccaagggccccagcgtgttccctctggccccttgtagcagaagcaccagcgagtctacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgactgtgcccagcagctctctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcctagagaggaacagttcaacagcacctaccgggtggtgtccgtgctgacagtgctgcatcaggactggctgaacggcaaagagtacaagtgcaaggtgtccaacaagggcctgcccagctccatcgagaaaaccatcagcaaggccaagggccagccccgcgaaccccaggtgtacacactgcctccaagccaggaagagatgaccaagaaccaggtgtccctgacctgtctcgtgaaaggcttctacccctccgatatcgccgtggaatgggagagcaacggccagcccgagaacaactacaagacaaccccccctgtgctggacagcgacggctcattcttcctgtacagcagactgaccgtggacaagagccggtggcaggaaggcaacgtgttcagctgcagcgtgatgcacgaggccctgcacaaccactacacccagaagtccctgtctctgagcctgggcaagtga

SEQ ID NO: 201 - protein, 471 aa, artificial sequence
  Synthetic Construct
MSPLVSSLLLLAALPGRAEVQLLESGGGLVQPGGSLRLSCAASGFTFSSVTMQWVRQAPGKGLEFVSSVCSGSSTYYAPAVKGRFTISRDNSKNTVYLQMNSLRAEDTAVYYCAKIAGRARWSCTSAAYNIDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 202 - DNA, 1416 bp, artificial sequence
  humanized-IgG4-H3-complete
  CDS (1)..(1416)
  sig_peptide (1)..(54)
atgagcccactcgtctcctccctcctgctcctggccgccctgccagggcgcgccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtggccagcgtgtgcagcggcagcagcacctattatgcccctgccgtgaagggcagagtgaccatcagccgggacaacagcaagaacaccgtgtacctgcagatgaacagcctgcgggccgaggacaccgccgtgtactactgtgccaagatcgccggcagagcccggtggtcttgtaccagcgccgcctacaacatcgacgcctggggacagggaaccctggtcaccgtctcctcagccagcaccaagggccccagcgtgttccctctggccccttgtagcagaagcaccagcgagtctacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgactgtgcccagcagctctctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcctagagaggaacagttcaacagcacctaccgggtggtgtccgtgctgacagtgctgcatcaggactggctgaacggcaaagagtacaagtgcaaggtgtccaacaagggcctgcccagctccatcgagaaaaccatcagcaaggccaagggccagccccgcgaaccccaggtgtacacactgcctccaagccaggaagagatgaccaagaaccaggtgtccctgacctgtctcgtgaaaggcttctacccctccgatatcgccgtggaatgggagagcaacggccagcccgagaacaactacaagacaaccccccctgtgctggacagcgacggctcattcttcctgtacagcagactgaccgtggacaagagccggtggcaggaaggcaacgtgttcagctgcagcgtgatgcacgaggccctgcacaaccactacacccagaagtccctgtctctgagcctgggcaagtga

SEQ ID NO: 203 - protein, 471 aa, artificial sequence
  Synthetic Construct
MSPLVSSLLLLAALPGRAEVQLLESGGGLVQPGGSLRLSCAASGFTFSSVTMQWVRQAPGKGLEFVASVCSGSSTYYAPAVKGRVTISRDNSKNTVYLQMNSLRAEDTAVYYCAKIAGRARWSCTSAAYNIDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 204 - DNA, 693 bp, artificial sequence
  humanized-L1-complete
  CDS (1)..(693)
  sig_peptide (1)..(54)
atgagcccactcgtctcctccctcctgctcctggccgccctgccagggcgcgccagctatgagctgactcagccacccagcgtgtccgtgtctcctggccagaccgccagaatcacctgtagcggcggaggcaacaactacggctggtatcagcagaagcccggccaggcccctgtgaccgtgatctactacaacgacaaccggcccagcggcatccccgagagattcagcggcagcaatagcggctccaccaccaccctgacaatcagcggagtgcaggccgaggacgaggccgattactactgcggcagctgggacagcaacaccgactccggcatctttggcggcggaaccaagctgaccgtcctgggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 205 - protein, 230 aa, artificial sequence
  Synthetic Construct
MSPLVSSLLLLAALPGRASYELTQPPSVSVSPGQTARITCSGGGNNYGWYQQKPGQAPVTVIYYNDNRPSGIPERFSGSNSGSTTTLTISGVQAEDEADYYCGSWDSNTDSGIFGGGTKLTVLGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 30 aa, artificial sequence
  chicken-Heavy-FR1-for-reference
AVTLDESGGGLQTPGGALSLVCKASGFFFF

SEQ ID NO: 207 - protein, 14 aa, artificial sequence
  chicken-Heavy-FR2-for-reference
WVRQAPGKGLEWVA

SEQ ID NO: 208 - protein, 32 aa, artificial sequence
  chicken-Heavy-FR3-for-reference
RATISRDNGQSTVRLQLNNLRAEDTGTYYCAR

SEQ ID NO: 209 - protein, 11 aa, artificial sequence
  chicken-Heavy-FR4-for-reference
WGHGTEVIVSP

SEQ ID NO: 210 - protein, 20 aa, artificial sequence
  chicken-Light-FR1-for-reference
ASTQPSSVSANPGETVKITC

SEQ ID NO: 211 - protein, 16 aa, artificial sequence
  chicken-Light-FR2-for-reference
WYQQKSPGSAPVTVIY

SEQ ID NO: 212 - protein, 32 aa, artificial sequence
  chicken-Light-FR3-for-reference
NIPSRFSGSKSGSTGTLTITGVRAEDEAVYFC

SEQ ID NO: 213 - protein, 10 aa, artificial sequence
  chicken-Light-FR4-for-reference
FGAGTTLTVL

SEQ ID NO: 214 - protein, 16 aa, artificial sequence
  chicken-alternative-Light-FR2-for-reference
WYQQKSPGSAPVTVIY

SEQ ID NO: 215 - protein, 10 aa, artificial sequence
  chicken-alternative-Light-FR3-for-reference
FGAGTTLTVL

SEQ ID NO: 216 - DNA, 21 bp, artificial sequence
  delta 193-204 (Forward primer)
agcgacgagaacgccgactgg

SEQ ID NO: 217 - DNA, 25 bp, artificial sequence
  delta 193-204 (Reverse primer)
cagcttgttgttttcctggtcgggg

SEQ ID NO: 218 - DNA, 21 bp, artificial sequence
  delta 205-216 (Forward primer)
gaatttctgaagtgcctgaac

SEQ ID NO: 219 - DNA, 21 bp, artificial sequence
  delta 205-216 (Reverse primer)
cagctcaatcagggcgtccac

SEQ ID NO: 220 - DNA, 25 bp, artificial sequence
  delta 217-228 (Forward primer)
cccgagaagaagtgcgccctggagg

SEQ ID NO: 221 - DNA, 21 bp, artificial sequence
  delta 217-228 (Reverse primer)
ctgaaagctcagcttccagtc

SEQ ID NO: 222 - DNA, 21 bp, artificial sequence
  delta 233-251 (Forward primer)
agatgcgtgtgcgcctgcggc

SEQ ID NO: 223 - DNA, 25 bp, artificial sequence
  delta 233-251 (Reverse primer)
cttcttctcgggggggttgaagctg

SEQ ID NO: 224 - DNA, 21 bp, artificial sequence
  delta 252-270 (Forward primer)
aatcagaagggcgcccagacc

SEQ ID NO: 225 - DNA, 22 bp, artificial sequence
  delta 252-270 (Reverse primer)
gttgcagtccacctctgtctcg

SEQ ID NO: 226 - DNA, 25 bp, artificial sequence
  delta 271-289 (Forward primer)
cttcttctcgggggggttgaagctg

SEQ ID NO: 227 - DNA, 22 bp, artificial sequence
  delta 271-289 (Reverse primer)
cttgccgtcgcaggtcatggcg

SEQ ID NO: 228 - DNA, 21 bp, artificial sequence
  delta 48-100 (Forward primer)
aagaaaagcgtgtcccccagc

SEQ ID NO: 229 - DNA, 21 bp, artificial sequence
  delta 48-100 (Reverse primer)
cttctcggtcacggcacattc

SEQ ID NO: 230 - DNA, 66 bp, artificial sequence; identical to SEQ ID NO: 184
  humanizedL2-FR1
  CDS (1)..(66)

SEQ ID NO: 231 - protein, 22 aa, artificial sequence
  Synthetic Construct
SYELTQPPSVSVSPGQTARITC

SEQ ID NO: 232 - DNA, 45 bp, artificial sequence; identical to SEQ ID NO: 186
  humanizedL2-FR2
  CDS (1)..(45)

SEQ ID NO: 233 - protein, 15 aa, artificial sequence
  Synthetic Construct
WYQQKPGQAPVTVIY

SEQ ID NO: 234 - DNA, 96 bp, artificial sequence
  humanizedL2-FR3
  CDS (1)..(96)
ggcatccccgagagattttctggcagcaccagcggctccaccaccaccctgacaatctctggcgtgcaggccgaggacgaggccgattactactgc

SEQ ID NO: 235 - protein, 32 aa, artificial sequence
  Synthetic Construct
GIPERFSGSTSGSTTTLTISGVQAEDEADYYC

SEQ ID NO: 236 - DNA, 30 bp, artificial sequence; identical to SEQ ID NO: 190
  humanizedL2-FR4
  CDS (1)..(30)

SEQ ID NO: 237 - protein, 10 aa, artificial sequence
  Synthetic Construct
FGGGTKLTVL

SEQ ID NO: 238 - DNA, 66 bp, artificial sequence; identical to SEQ ID NO: 184
  humanizedL3-FR1
  CDS (1)..(66)

SEQ ID NO: 239 - protein, 22 aa, artificial sequence
  Synthetic Construct
SYELTQPPSVSVSPGQTARITC

SEQ ID NO: 240 - DNA, 45 bp, artificial sequence; identical to SEQ ID NO: 186
  humanizedL3-FR2
  CDS (1)..(45)

SEQ ID NO: 241 - protein, 15 aa, artificial sequence
  Synthetic Construct
WYQQKPGQAPVTVIY

SEQ ID NO: 242 - DNA, 96 bp, artificial sequence
  humanizedL3-FR3
  CDS (1)..(96)
ggcatccccgagagattcagcggcagcaacagcggcaataccgccaccctgacaatcagcggagtgcaggccgaggacgaggccgattactactgc

SEQ ID NO: 243 - protein, 32 aa, artificial sequence
  Synthetic Construct
GIPERFSGSNSGNTATLTISGVQAEDEADYYC

SEQ ID NO: 244 - DNA, 30 bp, artificial sequence; identical to SEQ ID NO: 190
  humanizedL3-FR4
  CDS (1)..(30)

SEQ ID NO: 245 - protein, 10 aa, artificial sequence
  Synthetic Construct
FGGGTKLTVL

SEQ ID NO: 246 - DNA, 693 bp, artificial sequence
  humanizedL2-complete
  CDS (1)..(693)
  sig_peptide (1)..(54)
atgagcccactcgtctcctccctcctgctcctggccgccctgccagggcgcgccagctatgagctgactcagccacccagcgtgtccgtgtctcctggccagaccgccagaatcacctgtagcggcggaggcaacaactacggctggtatcagcagaagcccggccaggcccctgtgaccgtgatctactacaacgacaaccggcccagcggcatccccgagagattttctggcagcaccagcggctccaccaccaccctgacaatctctggcgtgcaggccgaggacgaggccgattactactgcggcagctgggacagcaacaccgactccggcatctttggcggcggaaccaagctgaccgtcctgggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 247 - protein, 230 aa, artificial sequence
  Synthetic Construct
MSPLVSSLLLLAALPGRASYELTQPPSVSVSPGQTARITCSGGGNNYGWYQQKPGQAPVTVIYYNDNRPSGIPERFSGSTSGSTTTLTISGVQAEDEADYYCGSWDSNTDSGIFGGGTKLTVLGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - DNA, 693 bp, artificial sequence
  humanizedL3-complete
  CDS (1)..(693)
  sig_peptide (1)..(54)
atgagcccactcgtctcctccctcctgctcctggccgccctgccagggcgcgccagctatgagctgactcagccacccagcgtgtccgtgtctcctggccagaccgccagaatcacctgtagcggcggaggcaacaactacggctggtatcagcagaagcccggccaggcccctgtgaccgtgatctactacaacgacaaccggcccagcggcatccccgagagattcagcggcagcaacagcggcaataccgccaccctgacaatcagcggagtgcaggccgaggacgaggccgattactactgcggcagctgggacagcaacaccgactccggcatctttggcggcggaaccaagctgaccgtcctgggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 249 - protein, 230 aa, artificial sequence
  Synthetic Construct
MSPLVSSLLLLAALPGRASYELTQPPSVSVSPGQTARITCSGGGNNYGWYQQKPGQAPVTVIYYNDNRPSGIPERFSGSNSGNTATLTISGVQAEDEADYYCGSWDSNTDSGIFGGGTKLTVLGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 250 - DNA, 927 bp, homo sapiens; identical to SEQ ID NO: 1
  CDS (1)..(927)
  sig_peptide (1)..(60)

SEQ ID NO: 251 - protein, 308 aa, homo sapiens; identical to SEQ ID NO: 2

SEQ ID NO: 252 - DNA, 921 bp, Mus musculus; identical to SEQ ID NO: 3
  CDS (1)..(921)
  sig_peptide (1)..(54)

SEQ ID NO: 253 - protein, 306 aa, Mus musculus; identical to SEQ ID NO: 4

SEQ ID NO: 254 - DNA, 318 bp, artificial sequence; identical to SEQ ID NO: 5
  light chain variable region of antibody clone #5-2
  CDS (1)..(318)

SEQ ID NO: 255 - protein, 106 aa, artificial sequence; identical to SEQ ID NO: 6
  Synthetic Construct

SEQ ID NO: 256 - DNA, 381 bp, artificial sequence; identical to SEQ ID NO: 7
  heavy chain variable region of antibody clone #5-2
  CDS (1)..(381)

SEQ ID NO: 257 - protein, 127 aa, artificial sequence; identical to SEQ ID NO: 8
  Synthetic Construct

SEQ ID NO: 258 - DNA, 312 bp, artificial sequence; identical to SEQ ID NO: 9
  light chain variable region of antibody clone #5-3
  CDS (1)..(312)

SEQ ID NO: 259 - protein, 104 aa, artificial sequence; identical to SEQ ID NO: 10
  Synthetic Construct

SEQ ID NO: 260 - DNA, 381 bp, artificial sequence; identical to SEQ ID NO: 11
  heavy chain variable region of antibody clone #5-3
  CDS (1)..(381)

SEQ ID NO: 261 - protein, 127 aa, artificial sequence; identical to SEQ ID NO: 12
  Synthetic Construct

SEQ ID NO: 262 - DNA, 318 bp, artificial sequence; identical to SEQ ID NO: 5
  light chain variable region of antibody clone #5-8
  CDS (1)..(318)

SEQ ID NO: 263 - protein, 106 aa, artificial sequence; identical to SEQ ID NO: 6
  Synthetic Construct

SEQ ID NO: 264 - DNA, 381 bp, artificial sequence; identical to SEQ ID NO: 15
  heavy chain variable region of antibody clone #5-8
  CDS (1)..(381)

SEQ ID NO: 265 - protein, 127 aa, artificial sequence; identical to SEQ ID NO: 16
  Synthetic Construct

SEQ ID NO: 266 - DNA, 324 bp, artificial sequence; identical to SEQ ID NO: 17
  light chain variable region of antibody clone #5-10
  CDS (1)..(324)

SEQ ID NO: 267 - protein, 108 aa, artificial sequence; identical to SEQ ID NO: 18
  Synthetic Construct

SEQ ID NO: 268 - DNA, 381 bp, artificial sequence; identical to SEQ ID NO: 19
  heavy chain variable region of antibody clone #5-10
  CDS (1)..(381)

SEQ ID NO: 269 - protein, 127 aa, artificial sequence; identical to SEQ ID NO: 20
  Synthetic Construct

SEQ ID NO: 270 - DNA, 318 bp, artificial sequence; identical to SEQ ID NO: 5
  light chain variable region of antibody clone #5-43
  CDS (1)..(318)

SEQ ID NO: 271 - protein, 106 aa, artificial sequence; identical to SEQ ID NO: 6
  Synthetic Construct

SEQ ID NO: 272 - DNA, 381 bp, artificial sequence; identical to SEQ ID NO: 23
  heavy chain variable region of antibody clone #5-43
  CDS (1)..(381)

SEQ ID NO: 273 - protein, 127 aa, artificial sequence; identical to SEQ ID NO: 24
  Synthetic Construct

SEQ ID NO: 274 - DNA, 312 bp, artificial sequence; identical to SEQ ID NO: 25
  light chain variable region of antibody clone #6-55
  CDS (1)..(312)

SEQ ID NO: 275 - protein, 104 aa, artificial sequence; identical to SEQ ID NO: 26
  Synthetic Construct

SEQ ID NO: 276 - DNA, 378 bp, artificial sequence; identical to SEQ ID NO: 27
  heavy chain variable region of antibody clone #6-55
  CDS (1)..(378)

SEQ ID NO: 277 - protein, 126 aa, artificial sequence; identical to SEQ ID NO: 28
  Synthetic Construct

SEQ ID NO: 278 - DNA, 312 bp, artificial sequence; identical to SEQ ID NO: 29
  light chain variable region of antibody clone #7-34
  CDS (1)..(312)

SEQ ID NO: 279 - protein, 104 aa, artificial sequence; identical to SEQ ID NO: 30
  Synthetic Construct

SEQ ID NO: 280 - DNA, 378 bp, artificial sequence; identical to SEQ ID NO: 31
  heavy chain variable region of antibody clone #7-34
  CDS (1)..(378)

SEQ ID NO: 281 - protein, 126 aa, artificial sequence; identical to SEQ ID NO: 32
  Synthetic Construct

SEQ ID NO: 282 - DNA, 318 bp, artificial sequence; identical to SEQ ID NO: 33
  light chain variable region of antibody clone #8-1
  CDS (1)..(318)

SEQ ID NO: 283 - protein, 106 aa, artificial sequence; identical to SEQ ID NO: 34
  Synthetic Construct

SEQ ID NO: 284 - DNA, 381 bp, artificial sequence; identical to SEQ ID NO: 35
  heavy chain variable region of antibody clone #8-1
  CDS (1)..(381)

SEQ ID NO: 285 - protein, 127 aa, artificial sequence; identical to SEQ ID NO: 36
  Synthetic Construct

SEQ ID NO: 286 - DNA, 312 bp, artificial sequence; identical to SEQ ID NO: 37
  light chain variable region of antibody clone #8-4
  CDS (1)..(312)

SEQ ID NO: 287 - protein, 104 aa, artificial sequence; identical to SEQ ID NO: 38
  Synthetic Construct

SEQ ID NO: 288 - DNA, 381 bp, artificial sequence; identical to SEQ ID NO: 39
  heavy chain variable region of antibody clone #8-4
  CDS (1)..(381)

SEQ ID NO: 289 - protein, 127 aa, artificial sequence; identical to SEQ ID NO: 40
  Synthetic Construct

SEQ ID NO: 290 - DNA, 318 bp, artificial sequence; identical to SEQ ID NO: 5
  light chain variable region of antibody clone #8-7
  CDS (1)..(318)

SEQ ID NO: 291 - protein, 106 aa, artificial sequence; identical to SEQ ID NO: 6
  Synthetic Construct

SEQ ID NO: 292 - DNA, 381 bp, artificial sequence; identical to SEQ ID NO: 43
  heavy chain variable region of antibody clone #8-7
  CDS (1)..(381)

SEQ ID NO: 293 - protein, 127 aa, artificial sequence; identical to SEQ ID NO: 44
  Synthetic Construct

SEQ ID NO: 294 - DNA, 318 bp, artificial sequence; identical to SEQ ID NO: 45
  light chain variable region of antibody clone #8-8
  CDS (1)..(318)

SEQ ID NO: 295 - protein, 106 aa, artificial sequence; identical to SEQ ID NO: 46
  Synthetic Construct

SEQ ID NO: 296 - DNA, 381 bp, artificial sequence; identical to SEQ ID NO: 47
  heavy chain variable region of antibody clone #8-8
  CDS (1)..(381)

SEQ ID NO: 297 - protein, 127 aa, artificial sequence; identical to SEQ ID NO: 48
  Synthetic Construct

SEQ ID NO: 298 - DNA, 309 bp, artificial sequence; identical to SEQ ID NO: 49
  light chain variable region of antibody clone #7
  CDS (1)..(309)
  misc_feature (40)..(40): n is a, c, g, or t
  misc_feature (44)..(45): n is a, c, g, or t

SEQ ID NO: 299 - protein, 103 aa, artificial sequence; identical to SEQ ID NO: 50
  misc_feature (14)..(14): The 'Xaa' at location 14 stands for Lys, Glu, or Gln.
  misc_feature (15)..(15): The 'Xaa' at location 15 stands for Lys, Asn, Arg, Ser, Thr, Ile, or Met.
  Synthetic Construct

SEQ ID NO: 300 - DNA, 390 bp, artificial sequence; identical to SEQ ID NO: 51
  heavy chain variable region of antibody clone #7
  CDS (1)..(390)

SEQ ID NO: 301 - protein, 130 aa, artificial sequence; identical to SEQ ID NO: 52
  Synthetic Construct

SEQ ID NO: 302 - DNA, 312 bp, artificial sequence; identical to SEQ ID NO: 53
  light chain variable region of antibody clone #10
  CDS (1)..(312)

SEQ ID NO: 303 - protein, 104 aa, artificial sequence; identical to SEQ ID NO: 54
  Synthetic Construct

SEQ ID NO: 304 - DNA, 390 bp, artificial sequence; identical to SEQ ID NO: 55
  heavy chain variable region of antibody clone #10
  CDS (1)..(390)

SEQ ID NO: 305 - protein, 130 aa, artificial sequence; identical to SEQ ID NO: 56
  Synthetic Construct

SEQ ID NO: 306 - DNA, 312 bp, artificial sequence; identical to SEQ ID NO: 57
  light chain variable region of antibody clone #13
  CDS (1)..(312)

SEQ ID NO: 307 - protein, 104 aa, artificial sequence; identical to SEQ ID NO: 58
  Synthetic Construct

SEQ ID NO: 308 - DNA, 378 bp, artificial sequence; identical to SEQ ID NO: 31
  heavy chain variable region of antibody clone #13
  CDS (1)..(378)

SEQ ID NO: 309 - protein, 126 aa, artificial sequence; identical to SEQ ID NO: 32
  Synthetic Construct

SEQ ID NO: 310 - DNA, 318 bp, artificial sequence; identical to SEQ ID NO: 61
  light chain variable region of antibody clone #22
  CDS (1)..(318)

SEQ ID NO: 311 - protein, 106 aa, artificial sequence; identical to SEQ ID NO: 62
  Synthetic Construct

SEQ ID NO: 312 - DNA, 369 bp, artificial sequence; identical to SEQ ID NO: 63
  heavy chain variable region of antibody clone #22
  CDS (1)..(369)

SEQ ID NO: 313 - protein, 123 aa, artificial sequence; identical to SEQ ID NO: 64
  Synthetic Construct

SEQ ID NO: 314 - DNA, 312 bp, artificial sequence; identical to SEQ ID NO: 65
  light chain variable region of antibody clone #33
  CDS (1)..(312)

SEQ ID NO: 315 - protein, 104 aa, artificial sequence; identical to SEQ ID NO: 66
  Synthetic Construct

SEQ ID NO: 316 - DNA, 354 bp, artificial sequence; identical to SEQ ID NO: 67
  heavy chain variable region of antibody clone #33
  CDS (1)..(354)

SEQ ID NO: 317 - protein, 118 aa, artificial sequence; identical to SEQ ID NO: 68
  Synthetic Construct

SEQ ID NO: 318 - DNA, 966 bp, artificial sequence; identical to SEQ ID NO: 69
  FSTL1 used in Example (human)
  CDS (1)..(966)

SEQ ID NO: 319 - protein, 321 aa, artificial sequence; identical to SEQ ID NO: 70
  Synthetic Construct

SEQ ID NO: 320 - DNA, 960 bp, artificial sequence; identical to SEQ ID NO: 71
  FSTL1 used in Example (mouse)
  CDS (1)..(960)

SEQ ID NO: 321 - protein, 319 aa, artificial sequence; identical to SEQ ID NO: 72
  Synthetic Construct

SEQ ID NO: 322 - DNA, 61 bp, artificial sequence; identical to SEQ ID NO: 73
  MCS sequence

SEQ ID NO: 323 - DNA, 61 bp, artificial sequence; identical to SEQ ID NO: 74
  MCS sequence (complementary strand)

SEQ ID NO: 324 - DNA, 16 bp, artificial sequence
  insert sequence
cgaacccttaagcttg

SEQ ID NO: 325 - DNA, 15 bp, artificial sequence
  insert sequence
cgtggcatctagaca

SEQ ID NO: 326 - DNA, 25 bp, artificial sequence
  delta 21-53 (Forward primer)
tgcatcgagcagtgcaagccccaca

SEQ ID NO: 327 - DNA, 25 bp, artificial sequence
  delta 21-53 (Reverse primer)
ggcgcgcacccaagccacagccacc

SEQ ID NO: 328 - DNA, 25 bp, artificial sequence
  delta 100-140(Forward primer)
aagggcagcaactacagcgagatcc

SEQ ID NO: 329 - DNA, 25 bp, artificial sequence
  delta100-140( Reverse primer)
tttgcagtggccgtcgtagtccacc

SEQ ID NO: 330 - DNA, 25 bp, artificial sequence
  delta 148-170(Forward primer)
ttcgtggaacagaacgagacagcca

SEQ ID NO: 331 - DNA, 25 bp, artificial sequence
  delta 148-170( Reverse primer)
ctcgctgtagttgctgcccttgctg

SEQ ID NO: 332 - DNA, 25 bp, artificial sequence
  delta 181-190(Forward primer)
aagctgctgcggggcctgtgcgtgg

SEQ ID NO: 333 - DNA, 25 bp, artificial sequence
  delta 181-190( Reverse primer)
gttgatggctgtctcgttctgttcc

SEQ ID NO: 334 - DNA, 25 bp, artificial sequence
  delta 193-228(Forward primer)
cccgagaagaagtgcgccctggagg

SEQ ID NO: 335 - DNA, 25 bp, artificial sequence
  delta 193-228( Reverse primer)
cagcttgttgttttcctggtcgggg

SEQ ID NO: 336 - DNA, 25 bp, artificial sequence
  delta 233-289(Forward primer)
ctgcagaagcaccaggaaaccgccg

SEQ ID NO: 337 - DNA, 25 bp, artificial sequence
  delta 233-289( Reverse primer)
cttcttctcgggggggttgaagctg

SEQ ID NO: 338 - DNA, 26 bp, artificial sequence
  delta 148-154(Forward primer)
aacttcgacaacggcgacagcagact

SEQ ID NO: 339 - DNA, 25 bp, artificial sequence
  delta 148-154(Reverse primer)
ctcgctgtagttgctgcccttgctg

SEQ ID NO: 340 - DNA, 25 bp, artificial sequence
  delta 155-162(Forward primer)
ctggacagcagcgagttcctgaagt

SEQ ID NO: 341 - DNA, 25 bp, artificial sequence
  delta 155-162(Reverse primer)
cttgaagtacttgtccaggatctcg

SEQ ID NO: 342 - DNA, 25 bp, artificial sequence
  delta 163-170(Forward primer)
ttcgtggaacagaacgagacagcca

SEQ ID NO: 343 - DNA, 25 bp, artificial sequence
  delta 163-170(Reverse primer)
tctgctgtcgccgttgtcgaagttc

SEQ ID NO: 344 - DNA, 839 bp, artificial sequence; identical to SEQ ID NO: 95
  full length light chain of antibody clone #5-2
  CDS (1)..(48)
  Intron (49)..(173)
  CDS (174)..(836)

SEQ ID NO: 345 - protein, 237 aa, artificial sequence; identical to SEQ ID NO: 96
  Synthetic Construct

SEQ ID NO: 346 - DNA, 1629 bp, artificial sequence; identical to SEQ ID NO: 97
  full length heavy chain of antibody clone #5-2
  CDS (1)..(45)
  Intron (46)..(228)
  CDS (229)..(1626)

SEQ ID NO: 347 - protein, 481 aa, artificial sequence; identical to SEQ ID NO: 98
  Synthetic Construct

SEQ ID NO: 348 - DNA, 833 bp, artificial sequence; identical to SEQ ID NO: 99
  full length light chain of antibody clone #5-3
  CDS (1)..(48)
  Intron (49)..(173)
  CDS (174)..(830)

SEQ ID NO: 349 - protein, 235 aa, artificial sequence; identical to SEQ ID NO: 100
  Synthetic Construct

SEQ ID NO: 350 - DNA, 1629 bp, artificial sequence; identical to SEQ ID NO: 101
  full length heavy chain of antibody clone #5-3
  CDS (1)..(45)
  Intron (46)..(228)
  CDS (229)..(1626)

SEQ ID NO: 351 - protein, 481 aa, artificial sequence; identical to SEQ ID NO: 102
  Synthetic Construct

SEQ ID NO: 352 - DNA, 839 bp, artificial sequence; identical to SEQ ID NO: 95
  full length light chain of antibody clone #5-8
  CDS (1)..(48)
  Intron (49)..(173)
  CDS (174)..(836)

SEQ ID NO: 353 - protein, 237 aa, artificial sequence; identical to SEQ ID NO: 96
  Synthetic Construct

SEQ ID NO: 354 - DNA, 1629 bp, artificial sequence; identical to SEQ ID NO: 105
  full length heavy chain of antibody clone #5-8
  CDS (1)..(45)
  Intron (46)..(228)
  CDS (229)..(1626)

SEQ ID NO: 355 - protein, 481 aa, artificial sequence; identical to SEQ ID NO: 106
  Synthetic Construct

SEQ ID NO: 356 - DNA, 845 bp, artificial sequence; identical to SEQ ID NO: 107
  full length light chain of antibody clone #5-10
  CDS (1)..(48)
  Intron (49)..(173)
  CDS (174)..(842)

SEQ ID NO: 357 - protein, 239 aa, artificial sequence; identical to SEQ ID NO: 108
  Synthetic Construct

SEQ ID NO: 358 - DNA, 1629 bp, artificial sequence; identical to SEQ ID NO: 109
  full length heavy chain of antibody clone #5-10
  CDS (1)..(45)
  Intron (46)..(228)
  CDS (229)..(1626)

SEQ ID NO: 359 - protein, 481 aa, artificial sequence; identical to SEQ ID NO: 110
  Synthetic Construct

SEQ ID NO: 360 - DNA, 839 bp, artificial sequence; identical to SEQ ID NO: 95
  full length light chain of antibody clone #5-43
  CDS (1)..(48)
  Intron (49)..(173)
  CDS (174)..(836)

SEQ ID NO: 361 - protein, 237 aa, artificial sequence; identical to SEQ ID NO: 96
  Synthetic Construct

SEQ ID NO: 362 - DNA, 1629 bp, artificial sequence; identical to SEQ ID NO: 113
  full length heavy chain of antibody clone #5-43
  CDS (1)..(45)
  insert (46)..(228)
  CDS (229)..(1626)

SEQ ID NO: 363 - protein, 481 aa, artificial sequence; identical to SEQ ID NO: 114
  Synthetic Construct

SEQ ID NO: 364 - DNA, 833 bp, artificial sequence; identical to SEQ ID NO: 115
  full length light chain of antibody clone #6-55
  CDS (1)..(48)
  Intron (49)..(173)
  CDS (174)..(830)

SEQ ID NO: 365 - protein, 235 aa, artificial sequence; identical to SEQ ID NO: 116
  Synthetic Construct

SEQ ID NO: 366 - DNA, 1626 bp, artificial sequence; identical to SEQ ID NO: 117
  full length heavy chain of antibody clone #6-55
  CDS (1)..(45)
  Intron (46)..(228)
  CDS (229)..(1623)

SEQ ID NO: 367 - protein, 480 aa, artificial sequence; identical to SEQ ID NO: 118
  Synthetic Construct

SEQ ID NO: 368 - DNA, 833 bp, artificial sequence; identical to SEQ ID NO: 119
  full length light chain of antibody clone #7-34
  CDS (1)..(48)
  Intron (49)..(173)
  CDS (174)..(830)

SEQ ID NO: 369 - protein, 235 aa, artificial sequence; identical to SEQ ID NO: 120
  Synthetic Construct

SEQ ID NO: 370 - DNA, 1626 bp, artificial sequence; identical to SEQ ID NO: 121
  full length heavy chain of antibody clone #7-34
  CDS (1)..(45)
  Intron (46)..(228)
  CDS (229)..(1623)

SEQ ID NO: 371 - protein, 480 aa, artificial sequence; identical to SEQ ID NO: 122
  Synthetic Construct

SEQ ID NO: 372 - DNA, 839 bp, artificial sequence; identical to SEQ ID NO: 123
  full length light chain of antibody clone #8-1
  CDS (1)..(48)
  Intron (49)..(173)
  CDS (174)..(836)

SEQ ID NO: 373 - protein, 237 aa, artificial sequence; identical to SEQ ID NO: 124
  Synthetic Construct

SEQ ID NO: 374 - DNA, 1629 bp, artificial sequence; identical to SEQ ID NO: 125
  full length heavy chain of antibody clone #8-1
  CDS (1)..(45)
  Intron (46)..(228)
  CDS (229)..(1626)

SEQ ID NO: 375 - protein, 481 aa, artificial sequence; identical to SEQ ID NO: 126
  Synthetic Construct

SEQ ID NO: 376 - DNA, 833 bp, artificial sequence; identical to SEQ ID NO: 127
  full length light chain of antibody clone #8-4
  CDS (1)..(48)
  Intron (49)..(173)
  CDS (174)..(830)

SEQ ID NO: 377 - protein, 235 aa, artificial sequence; identical to SEQ ID NO: 128
  Synthetic Construct

SEQ ID NO: 378 - DNA, 1629 bp, artificial sequence; identical to SEQ ID NO: 129
  full length heavy chain of antibody clone #8-4
  CDS (1)..(45)
  Intron (46)..(228)
  CDS (229)..(1626)

SEQ ID NO: 379 - protein, 481 aa, artificial sequence; identical to SEQ ID NO: 130
  Synthetic Construct

SEQ ID NO: 380 - DNA, 839 bp, artificial sequence; identical to SEQ ID NO: 95
  full length light chain of antibody clone #8-7
  CDS (1)..(48)
  Intron (49)..(173)
  CDS (174)..(836)

SEQ ID NO: 381 - protein, 237 aa, artificial sequence; identical to SEQ ID NO: 96
  Synthetic Construct

SEQ ID NO: 382 - DNA, 1629 bp, artificial sequence; identical to SEQ ID NO: 133
  full length heavy chain of antibody clone #8-7
  CDS (1)..(45)
  Intron (46)..(173)
  CDS (229)..(1626)

SEQ ID NO: 383 - protein, 481 aa, artificial sequence; identical to SEQ ID NO: 134
  Synthetic Construct

SEQ ID NO: 384 - DNA, 839 bp, artificial sequence; identical to SEQ ID NO: 135
  full length light chain of antibody clone #8-8
  CDS (1)..(48)
  Intron (49)..(173)
  CDS (174)..(836)

SEQ ID NO: 385 - protein, 237 aa, artificial sequence; identical to SEQ ID NO: 136
  Synthetic Construct

SEQ ID NO: 386 - DNA, 1629 bp, artificial sequence; identical to SEQ ID NO: 137
  full length heavy chain of antibody clone #8-8
  CDS (1)..(45)
  Intron (46)..(228)
  CDS (229)..(1626)

SEQ ID NO: 387 - protein, 481 aa, artificial sequence; identical to SEQ ID NO: 138
  Synthetic Construct

SEQ ID NO: 388 - DNA, 830 bp, artificial sequence; identical to SEQ ID NO: 139
  full length light chain of antibody clone #7
  CDS (1)..(48)
  Intron (49)..(173)
  CDS (174)..(827)
  misc_feature (228)..(228): n is a, c, g, or t
  misc_feature (232)..(233): n is a, c, g, or t

SEQ ID NO: 389 - protein, 234 aa, artificial sequence; identical to SEQ ID NO: 140
  misc_feature (35)..(35): The 'Xaa' at location 35 stands for Lys, Glu, or Gln.
  misc_feature (36)..(36): The 'Xaa' at location 36 stands for Lys, Asn, Arg, Ser, Thr, Ile, or Met.
  Synthetic Construct

SEQ ID NO: 390 - DNA, 1638 bp, artificial sequence; identical to SEQ ID NO: 141
  full length heavy chain of antibody clone #7
  CDS (1)..(45)
  Intron (49)..(228)
  CDS (229)..(1635)

SEQ ID NO: 391 - protein, 484 aa, artificial sequence; identical to SEQ ID NO: 142
  Synthetic Construct

SEQ ID NO: 392 - DNA, 833 bp, artificial sequence; identical to SEQ ID NO: 143
  full length light chain of antibody clone #10
  CDS (1)..(48)
  Intron (49)..(173)
  CDS (174)..(830)

SEQ ID NO: 393 - protein, 235 aa, artificial sequence; identical to SEQ ID NO: 144
  Synthetic Construct

SEQ ID NO: 394 - DNA, 1638 bp, artificial sequence; identical to SEQ ID NO: 145
  full length heavy chain of antibody clone #10
  CDS (1)..(45)
  Intron (46)..(228)
  CDS (229)..(1635)

SEQ ID NO: 395 - protein, 484 aa, artificial sequence; identical to SEQ ID NO: 146
  Synthetic Construct

SEQ ID NO: 396 - DNA, 833 bp, artificial sequence; identical to SEQ ID NO: 147
  full length light chain of antibody clone #13
  CDS (1)..(48)
  Intron (49)..(173)
  CDS (174)..(830)

SEQ ID NO: 397 - protein, 235 aa, artificial sequence; identical to SEQ ID NO: 148
  Synthetic Construct

SEQ ID NO: 398 - DNA, 1626 bp, artificial sequence; identical to SEQ ID NO: 121
  full length heavy chain of antibody clone #13
  CDS (1)..(45)
  Intron (46)..(228)
  CDS (229)..(1623)

SEQ ID NO: 399 - protein, 480 aa, artificial sequence; identical to SEQ ID NO: 122
  Synthetic Construct

SEQ ID NO: 400 - DNA, 839 bp, artificial sequence; identical to SEQ ID NO: 151
  full length light chain of antibody clone #22
  CDS (1)..(48)
  Intron (49)..(173)
  CDS (174)..(836)

SEQ ID NO: 401 - protein, 237 aa, artificial sequence; identical to SEQ ID NO: 152
  Synthetic Construct

SEQ ID NO: 402 - DNA, 1617 bp, artificial sequence; identical to SEQ ID NO: 153
  full length heavy chain of antibody clone #22
  CDS (1)..(45)
  Intron (46)..(228)
  CDS (229)..(1614)

SEQ ID NO: 403 - protein, 477 aa, artificial sequence; identical to SEQ ID NO: 154
  Synthetic Construct

SEQ ID NO: 404 - DNA, 833 bp, artificial sequence; identical to SEQ ID NO: 155
  full length light chain of antibody clone #33
  CDS (1)..(48)
  Intron (49)..(173)
  CDS (174)..(830)

SEQ ID NO: 405 - protein, 235 aa, artificial sequence; identical to SEQ ID NO: 156
  Synthetic Construct

SEQ ID NO: 406 - DNA, 1602 bp, artificial sequence; identical to SEQ ID NO: 157
  full length heavy chain of antibody clone #33
  CDS (1)..(45)
  Intron (46)..(228)
  CDS (229)..(1599)

SEQ ID NO: 407 - protein, 472 aa, artificial sequence; identical to SEQ ID NO: 158
  Synthetic Construct

SEQ ID NO: 408 - protein, 290 aa, artificial sequence; identical to SEQ ID NO: 159
  FSTL1 from Novoprotein

SEQ ID NO: 409 - DNA, 90 bp, artificial sequence; identical to SEQ ID NO: 160
  humanaizedH1-FR1
  CDS (1)..(90)

SEQ ID NO: 410 - protein, 30 aa, artificial sequence; identical to SEQ ID NO: 161
  Synthetic Construct

SEQ ID NO: 411 - DNA, 42 bp, artificial sequence; identical to SEQ ID NO: 162
  humanaizedH1-FR2
  CDS (1)..(42)

SEQ ID NO: 412 - protein, 14 aa, artificial sequence
  Synthetic Construct
WVRQAPGKGLEFVA

SEQ ID NO: 413 - DNA, 96 bp, artificial sequence; identical to SEQ ID NO: 164
  humanaizedH1-FR3
  CDS (1)..(96)

SEQ ID NO: 414 - protein, 32 aa, artificial sequence; identical to SEQ ID NO: 165
  Synthetic Construct

SEQ ID NO: 415 - DNA, 33 bp, artificial sequence; identical to SEQ ID NO: 166
  humanaizedH1-FR4
  CDS (1)..(33)

SEQ ID NO: 416 - protein, 11 aa, artificial sequence
  Synthetic Construct
WGQGTLVTVSS

SEQ ID NO: 417 - DNA, 90 bp, artificial sequence; identical to SEQ ID NO: 160
  humanaizedH2-FR1
  CDS (1)..(90)

SEQ ID NO: 418 - protein, 30 aa, artificial sequence; identical to SEQ ID NO: 161
  Synthetic Construct

SEQ ID NO: 419 - DNA, 42 bp, artificial sequence; identical to SEQ ID NO: 170
  humanaizedH2-FR2
  CDS (1)..(42)

SEQ ID NO: 420 - protein, 14 aa, artificial sequence
  Synthetic Construct
WVRQAPGKGLEFVS

SEQ ID NO: 421 - DNA, 96 bp, artificial sequence; identical to SEQ ID NO: 172
  humanaizedH2-FR3
  CDS (1)..(96)

SEQ ID NO: 422 - protein, 32 aa, artificial sequence; identical to SEQ ID NO: 173
  Synthetic Construct

SEQ ID NO: 423 - DNA, 33 bp, artificial sequence; identical to SEQ ID NO: 174
  humanaizedH2-FR4
  CDS (1)..(33)

SEQ ID NO: 424 - protein, 11 aa, artificial sequence
  Synthetic Construct
WGQGTLVTVSS

SEQ ID NO: 425 - DNA, 90 bp, artificial sequence; identical to SEQ ID NO: 160
  humanaizedH3-FR1
  CDS (1)..(90)

SEQ ID NO: 426 - protein, 30 aa, artificial sequence; identical to SEQ ID NO: 161
  Synthetic Construct

SEQ ID NO: 427 - DNA, 42 bp, artificial sequence; identical to SEQ ID NO: 162
  humanaizedH3-FR2
  CDS (1)..(42)

SEQ ID NO: 428 - protein, 14 aa, artificial sequence
  Synthetic Construct
WVRQAPGKGLEFVA

SEQ ID NO: 429 - DNA, 96 bp, artificial sequence; identical to SEQ ID NO: 180
  humanaizedH3-FR3
  CDS (1)..(96)

SEQ ID NO: 430 - protein, 32 aa, artificial sequence; identical to SEQ ID NO: 181
  Synthetic Construct

SEQ ID NO: 431 - DNA, 33 bp, artificial sequence; identical to SEQ ID NO: 166
  humanaizedH3-FR4
  CDS (1)..(33)

SEQ ID NO: 432 - protein, 11 aa, artificial sequence
  Synthetic Construct
WGQGTLVTVSS

SEQ ID NO: 433 - DNA, 66 bp, artificial sequence; identical to SEQ ID NO: 184
  humanaizedL1-FR1
  CDS (1)..(66)

SEQ ID NO: 434 - protein, 22 aa, artificial sequence
  Synthetic Construct
SYELTQPPSVSVSPGQTARITC

SEQ ID NO: 435 - DNA, 45 bp, artificial sequence; identical to SEQ ID NO: 186
  humanaizedL1-FR2
  CDS (1)..(45)

SEQ ID NO: 436 - protein, 15 aa, artificial sequence
  Synthetic Construct
WYQQKPGQAPVTVIY

SEQ ID NO: 437 - DNA, 96 bp, artificial sequence; identical to SEQ ID NO: 188
  humanaizedL1-FR3
  CDS (1)..(96)

SEQ ID NO: 438 - protein, 32 aa, artificial sequence; identical to SEQ ID NO: 189
  Synthetic Construct

SEQ ID NO: 439 - DNA, 30 bp, artificial sequence; identical to SEQ ID NO: 190
  humanaizedL1-FR4
  CDS (1)..(30)

SEQ ID NO: 440 - protein, 10 aa, artificial sequence
  Synthetic Construct
FGGGTKLTVL

SEQ ID NO: 441 - DNA, 1425 bp, artificial sequence; identical to SEQ ID NO: 192
  humanized-IgG1-H1-complete
  CDS (1)..(1425)
  sig_peptide (1)..(54)

SEQ ID NO: 442 - protein, 474 aa, artificial sequence; identical to SEQ ID NO: 193
  Synthetic Construct

SEQ ID NO: 443 - DNA, 1425 bp, artificial sequence; identical to SEQ ID NO: 194
  humanized-IgG1-H2-complete
  CDS (1)..(1425)
  sig_peptide (1)..(54)

SEQ ID NO: 444 - protein, 474 aa, artificial sequence; identical to SEQ ID NO: 195
  Synthetic Construct

SEQ ID NO: 445 - DNA, 1425 bp, artificial sequence; identical to SEQ ID NO: 196
  humanized-IgG1-H3-complete
  CDS (1)..(1425)
  sig_peptide (1)..(54)

SEQ ID NO: 446 - protein, 474 aa, artificial sequence; identical to SEQ ID NO: 197
  Synthetic Construct

SEQ ID NO: 447 - DNA, 1416 bp, artificial sequence; identical to SEQ ID NO: 198
  humanized-IgG4-H1-complete
  CDS (1)..(1416)
  sig_peptide (1)..(54)

SEQ ID NO: 448 - protein, 471 aa, artificial sequence; identical to SEQ ID NO: 199
  Synthetic Construct

SEQ ID NO: 449 - DNA, 1416 bp, artificial sequence; identical to SEQ ID NO: 200
  humanized-IgG4-H2-complete
  CDS (1)..(1416)
  sig_peptide (1)..(54)

SEQ ID NO: 450 - protein, 471 aa, artificial sequence; identical to SEQ ID NO: 201
  Synthetic Construct

SEQ ID NO: 451 - DNA, 1416 bp, artificial sequence; identical to SEQ ID NO: 202
  humanized-IgG4-H3-complete
  CDS (1)..(1416)
  sig_peptide (1)..(54)

SEQ ID NO: 452 - protein, 471 aa, artificial sequence; identical to SEQ ID NO: 203
  Synthetic Construct

SEQ ID NO: 453 - DNA, 693 bp, artificial sequence; identical to SEQ ID NO: 204
  humanized-L1-complete
  CDS (1)..(693)
  sig_peptide (1)..(54)

SEQ ID NO: 454 - protein, 230 aa, artificial sequence; identical to SEQ ID NO: 205
  Synthetic Construct

SEQ ID NO: 455 - protein, 30 aa, artificial sequence; identical to SEQ ID NO: 206
  chicken-Heavy-FR1-for-reference

SEQ ID NO: 456 - protein, 14 aa, artificial sequence
  chicken-Heavy-FR2-for-reference
WVRQAPGKGLEWVA

SEQ ID NO: 457 - protein, 32 aa, artificial sequence; identical to SEQ ID NO: 208
  chicken-Heavy-FR3-for-reference

SEQ ID NO: 458 - protein, 11 aa, artificial sequence
  chicken-Heavy-FR4-for-reference
WGHGTEVIVSP

SEQ ID NO: 459 - protein, 20 aa, artificial sequence
  chicken-Light-FR1-for-reference
ASTQPSSVSANPGETVKITC

SEQ ID NO: 460 - protein, 16 aa, artificial sequence
  chicken-Light-FR2-for-reference
WYQQKSPGSAPVTVIY

SEQ ID NO: 461 - protein, 32 aa, artificial sequence; identical to SEQ ID NO: 212
  chicken-Light-FR3-for-reference

SEQ ID NO: 462 - protein, 10 aa, artificial sequence
  chicken-Light-FR4-for-reference
FGAGTTLTVL

SEQ ID NO: 463 - protein, 16 aa, artificial sequence
  chicken-alternative-Light-FR2-for-reference
WYQQKSPGSAPVTVIY

SEQ ID NO: 464 - protein, 10 aa, artificial sequence
  chicken-alternative-Light-FR3-for-reference
FGAGTTLTVL

SEQ ID NO: 465 - DNA, 21 bp, artificial sequence
  delta 193-204 (Forward primer)
agcgacgagaacgccgactgg

SEQ ID NO: 466 - DNA, 25 bp, artificial sequence
  delta 193-204 (Reverse primer)
cagcttgttgttttcctggtcgggg

SEQ ID NO: 467 - DNA, 21 bp, artificial sequence
  delta 205-216 (Forward primer)
gaatttctgaagtgcctgaac

SEQ ID NO: 468 - DNA, 21 bp, artificial sequence
  delta 205-216 (Reverse primer)
cagctcaatcagggcgtccac

SEQ ID NO: 469 - DNA, 25 bp, artificial sequence
  delta 217-228 (Forward primer)
cccgagaagaagtgcgccctggagg

SEQ ID NO: 470 - DNA, 21 bp, artificial sequence
  delta 217-228 (Reverse primer)
ctgaaagctcagcttccagtc

SEQ ID NO: 471 - DNA, 21 bp, artificial sequence
  delta 233-251 (Forward primer)
agatgcgtgtgcgcctgcggc

SEQ ID NO: 472 - DNA, 25 bp, artificial sequence
  delta 233-251 (Reverse primer)
cttcttctcgggggggttgaagctg

SEQ ID NO: 473 - DNA, 21 bp, artificial sequence
  delta 252-270 (Forward primer)
aatcagaagggcgcccagacc

SEQ ID NO: 474 - DNA, 22 bp, artificial sequence
  delta 252-270 (Reverse primer)
gttgcagtccacctctgtctcg

SEQ ID NO: 475 - DNA, 25 bp, artificial sequence
  delta 271-289 (Forward primer)
cttcttctcgggggggttgaagctg

SEQ ID NO: 476 - DNA, 22 bp, artificial sequence
  delta 271-289 (Reverse primer)
cttgccgtcgcaggtcatggcg

SEQ ID NO: 477 - DNA, 21 bp, artificial sequence
  delta 48-100 (Forward primer)
aagaaaagcgtgtcccccagc

SEQ ID NO: 478 - DNA, 21 bp, artificial sequence
  delta 48-100 (Reverse primer)
cttctcggtcacggcacattc

SEQ ID NO: 479 - DNA, 66 bp, artificial sequence; identical to SEQ ID NO: 184
  humanizedL2-FR1
  CDS (1)..(66)

SEQ ID NO: 480 - protein, 22 aa, artificial sequence
  Synthetic Construct
SYELTQPPSVSVSPGQTARITC

SEQ ID NO: 481 - DNA, 45 bp, artificial sequence; identical to SEQ ID NO: 186
  humanizedL2-FR2
  CDS (1)..(45)

SEQ ID NO: 482 - protein, 15 aa, artificial sequence
  Synthetic Construct
WYQQKPGQAPVTVIY

SEQ ID NO: 483 - DNA, 96 bp, artificial sequence; identical to SEQ ID NO: 234
  humanizedL2-FR3
  CDS (1)..(96)

SEQ ID NO: 484 - protein, 32 aa, artificial sequence; identical to SEQ ID NO: 235
  Synthetic Construct

SEQ ID NO: 485 - DNA, 30 bp, artificial sequence; identical to SEQ ID NO: 190
  humanizedL2-FR4
  CDS (1)..(30)

SEQ ID NO: 486 - protein, 10 aa, artificial sequence
  Synthetic Construct
FGGGTKLTVL

SEQ ID NO: 487 - DNA, 66 bp, artificial sequence; identical to SEQ ID NO: 184
  humanizedL3-FR1
  CDS (1)..(66)

SEQ ID NO: 488 - protein, 22 aa, artificial sequence
  Synthetic Construct
SYELTQPPSVSVSPGQTARITC

SEQ ID NO: 489 - DNA, 45 bp, artificial sequence; identical to SEQ ID NO: 186
  humanizedL3-FR2
  CDS (1)..(45)

SEQ ID NO: 490 - protein, 15 aa, artificial sequence
  Synthetic Construct
WYQQKPGQAPVTVIY

SEQ ID NO: 491 - DNA, 96 bp, artificial sequence; identical to SEQ ID NO: 242
  humanizedL3-FR3
  CDS (1)..(96)

SEQ ID NO: 492 - protein, 32 aa, artificial sequence; identical to SEQ ID NO: 243
  Synthetic Construct

SEQ ID NO: 493 - DNA, 30 bp, artificial sequence; identical to SEQ ID NO: 190
  humanizedL3-FR4
  CDS (1)..(30)

SEQ ID NO: 494 - protein, 10 aa, artificial sequence
  Synthetic Construct
FGGGTKLTVL

SEQ ID NO: 495 - DNA, 693 bp, artificial sequence; identical to SEQ ID NO: 246
  humanizedL2-complete
  CDS (1)..(693)
  sig_peptide (1)..(54)

SEQ ID NO: 496 - protein, 230 aa, artificial sequence; identical to SEQ ID NO: 247
  Synthetic Construct

SEQ ID NO: 497 - DNA, 693 bp, artificial sequence; identical to SEQ ID NO: 248
  humanizedL3-complete
  CDS (1)..(693)
  sig_peptide (1)..(54)

SEQ ID NO: 498 - protein, 230 aa, artificial sequence; identical to SEQ ID NO: 249
  Synthetic Construct

SEQ ID NO: 499 - DNA, 870 bp, Homo sapiens
  CDS (1)..(870)
  sig_peptide (1)..(54)
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacg

SEQ ID NO: 500 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 501 - DNA, 873 bp, Mus musculus
  CDS (1)..(873)
  sig_peptide (1)..(54)
atgaggatatttgctggcattatattcacagcctgctgtcacttgctacgggcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatgccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccagaactgcctgcaacacatcctccacagaacaggactcactgggtgcttctgggatccatcctgttgttcctcattgtagtgtccacggtcctcctcttcttgagaaaacaagtgagaatgctagatgtggagaaatgtggcgttgaagatacaagctcaaaaaaccgaaatgatacacaattcgaggagacgtaa

SEQ ID NO: 502 - protein, 290 aa, Mus musculus
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 503 - DNA, 927 bp, homo sapiens; identical to SEQ ID NO: 1
  CDS (1)..(927)
  sig_peptide (1)..(60)

SEQ ID NO: 504 - protein, 308 aa, homo sapiens; identical to SEQ ID NO: 2

SEQ ID NO: 505 - DNA, 921 bp, Mus musculus; identical to SEQ ID NO: 3
  CDS (1)..(921)
  sig_peptide (1)..(54)

SEQ ID NO: 506 - protein, 306 aa, Mus musculus; identical to SEQ ID NO: 4

SEQ ID NO: 507 - DNA, 318 bp, artificial sequence; identical to SEQ ID NO: 5
  light chain variable region of antibody clone #5-2
  CDS (1)..(318)

SEQ ID NO: 508 - protein, 106 aa, artificial sequence; identical to SEQ ID NO: 6
  Synthetic Construct

SEQ ID NO: 509 - DNA, 381 bp, artificial sequence; identical to SEQ ID NO: 7
  heavy chain variable region of antibody clone #5-2
  CDS (1)..(381)

SEQ ID NO: 510 - protein, 127 aa, artificial sequence; identical to SEQ ID NO: 8
  Synthetic Construct

SEQ ID NO: 511 - DNA, 312 bp, artificial sequence; identical to SEQ ID NO: 9
  light chain variable region of antibody clone #5-3
  CDS (1)..(312)

SEQ ID NO: 512 - protein, 104 aa, artificial sequence; identical to SEQ ID NO: 10
  Synthetic Construct

SEQ ID NO: 513 - DNA, 381 bp, artificial sequence; identical to SEQ ID NO: 11
  heavy chain variable region of antibody clone #5-3
  CDS (1)..(381)

SEQ ID NO: 514 - protein, 127 aa, artificial sequence; identical to SEQ ID NO: 12
  Synthetic Construct

SEQ ID NO: 515 - DNA, 318 bp, artificial sequence; identical to SEQ ID NO: 5
  light chain variable region of antibody clone #5-8
  CDS (1)..(318)

SEQ ID NO: 516 - protein, 106 aa, artificial sequence; identical to SEQ ID NO: 6
  Synthetic Construct

SEQ ID NO: 517 - DNA, 381 bp, artificial sequence; identical to SEQ ID NO: 15
  heavy chain variable region of antibody clone #5-8
  CDS (1)..(381)

SEQ ID NO: 518 - protein, 127 aa, artificial sequence; identical to SEQ ID NO: 16
  Synthetic Construct

SEQ ID NO: 519 - DNA, 324 bp, artificial sequence; identical to SEQ ID NO: 17
  light chain variable region of antibody clone #5-10
  CDS (1)..(324)

SEQ ID NO: 520 - protein, 108 aa, artificial sequence; identical to SEQ ID NO: 18
  Synthetic Construct

SEQ ID NO: 521 - DNA, 381 bp, artificial sequence; identical to SEQ ID NO: 19
  heavy chain variable region of antibody clone #5-10
  CDS (1)..(381)

SEQ ID NO: 522 - protein, 127 aa, artificial sequence; identical to SEQ ID NO: 20
  Synthetic Construct

SEQ ID NO: 523 - DNA, 318 bp, artificial sequence; identical to SEQ ID NO: 5
  light chain variable region of antibody clone #5-43
  CDS (1)..(318)

SEQ ID NO: 524 - protein, 106 aa, artificial sequence; identical to SEQ ID NO: 6
  Synthetic Construct

SEQ ID NO: 525 - DNA, 381 bp, artificial sequence; identical to SEQ ID NO: 23
  heavy chain variable region of antibody clone #5-43
  CDS (1)..(381)

SEQ ID NO: 526 - protein, 127 aa, artificial sequence; identical to SEQ ID NO: 24
  Synthetic Construct

SEQ ID NO: 527 - DNA, 312 bp, artificial sequence; identical to SEQ ID NO: 25
  light chain variable region of antibody clone #6-55
  CDS (1)..(312)

SEQ ID NO: 528 - protein, 104 aa, artificial sequence; identical to SEQ ID NO: 26
  Synthetic Construct

SEQ ID NO: 529 - DNA, 378 bp, artificial sequence; identical to SEQ ID NO: 27
  heavy chain variable region of antibody clone #6-55
  CDS (1)..(378)

SEQ ID NO: 530 - protein, 126 aa, artificial sequence; identical to SEQ ID NO: 28
  Synthetic Construct

SEQ ID NO: 531 - DNA, 312 bp, artificial sequence; identical to SEQ ID NO: 29
  light chain variable region of antibody clone #7-34
  CDS (1)..(312)

SEQ ID NO: 532 - protein, 104 aa, artificial sequence; identical to SEQ ID NO: 30
  Synthetic Construct

SEQ ID NO: 533 - DNA, 378 bp, artificial sequence; identical to SEQ ID NO: 31
  heavy chain variable region of antibody clone #7-34
  CDS (1)..(378)

SEQ ID NO: 534 - protein, 126 aa, artificial sequence; identical to SEQ ID NO: 32
  Synthetic Construct

SEQ ID NO: 535 - DNA, 318 bp, artificial sequence; identical to SEQ ID NO: 33
  light chain variable region of antibody clone #8-1
  CDS (1)..(318)

SEQ ID NO: 536 - protein, 106 aa, artificial sequence; identical to SEQ ID NO: 34
  Synthetic Construct

SEQ ID NO: 537 - DNA, 381 bp, artificial sequence; identical to SEQ ID NO: 35
  heavy chain variable region of antibody clone #8-1
  CDS (1)..(381)

SEQ ID NO: 538 - protein, 127 aa, artificial sequence; identical to SEQ ID NO: 36
  Synthetic Construct

SEQ ID NO: 539 - DNA, 312 bp, artificial sequence; identical to SEQ ID NO: 37
  light chain variable region of antibody clone #8-4
  CDS (1)..(312)

SEQ ID NO: 540 - protein, 104 aa, artificial sequence; identical to SEQ ID NO: 38
  Synthetic Construct

SEQ ID NO: 541 - DNA, 381 bp, artificial sequence; identical to SEQ ID NO: 39
  heavy chain variable region of antibody clone #8-4
  CDS (1)..(381)

SEQ ID NO: 542 - protein, 127 aa, artificial sequence; identical to SEQ ID NO: 40
  Synthetic Construct

SEQ ID NO: 543 - DNA, 318 bp, artificial sequence; identical to SEQ ID NO: 5
  light chain variable region of antibody clone #8-7
  CDS (1)..(318)

SEQ ID NO: 544 - protein, 106 aa, artificial sequence; identical to SEQ ID NO: 6
  Synthetic Construct

SEQ ID NO: 545 - DNA, 381 bp, artificial sequence; identical to SEQ ID NO: 43
  heavy chain variable region of antibody clone #8-7
  CDS (1)..(381)

SEQ ID NO: 546 - protein, 127 aa, artificial sequence; identical to SEQ ID NO: 44
  Synthetic Construct

SEQ ID NO: 547 - DNA, 318 bp, artificial sequence; identical to SEQ ID NO: 45
  light chain variable region of antibody clone #8-8
  CDS (1)..(318)

SEQ ID NO: 548 - protein, 106 aa, artificial sequence; identical to SEQ ID NO: 46
  Synthetic Construct

SEQ ID NO: 549 - DNA, 381 bp, artificial sequence; identical to SEQ ID NO: 47
  heavy chain variable region of antibody clone #8-8
  CDS (1)..(381)

SEQ ID NO: 550 - protein, 127 aa, artificial sequence; identical to SEQ ID NO: 48
  Synthetic Construct

SEQ ID NO: 551 - DNA, 309 bp, artificial sequence; identical to SEQ ID NO: 49
  light chain variable region of antibody clone #7
  CDS (1)..(309)
  misc_feature (40)..(40): n is a, c, g, or t
  misc_feature (44)..(45): n is a, c, g, or t

SEQ ID NO: 552 - protein, 103 aa, artificial sequence; identical to SEQ ID NO: 50
  misc_feature (14)..(14): The 'Xaa' at location 14 stands for Lys, Glu, or Gln.
  misc_feature (15)..(15): The 'Xaa' at location 15 stands for Lys, Asn, Arg, Ser, Thr, Ile, or Met.
  Synthetic Construct

SEQ ID NO: 553 - DNA, 390 bp, artificial sequence; identical to SEQ ID NO: 51
  heavy chain variable region of antibody clone #7
  CDS (1)..(390)

SEQ ID NO: 554 - protein, 130 aa, artificial sequence; identical to SEQ ID NO: 52
  Synthetic Construct

SEQ ID NO: 555 - DNA, 312 bp, artificial sequence; identical to SEQ ID NO: 53
  light chain variable region of antibody clone #10
  CDS (1)..(312)

SEQ ID NO: 556 - protein, 104 aa, artificial sequence; identical to SEQ ID NO: 54
  Synthetic Construct

SEQ ID NO: 557 - DNA, 390 bp, artificial sequence; identical to SEQ ID NO: 55
  heavy chain variable region of antibody clone #10
  CDS (1)..(390)

SEQ ID NO: 558 - protein, 130 aa, artificial sequence; identical to SEQ ID NO: 56
  Synthetic Construct

SEQ ID NO: 559 - DNA, 312 bp, artificial sequence; identical to SEQ ID NO: 57
  light chain variable region of antibody clone #13
  CDS (1)..(312)

SEQ ID NO: 560 - protein, 104 aa, artificial sequence; identical to SEQ ID NO: 58
  Synthetic Construct

SEQ ID NO: 561 - DNA, 378 bp, artificial sequence; identical to SEQ ID NO: 31
  heavy chain variable region of antibody clone #13
  CDS (1)..(378)

SEQ ID NO: 562 - protein, 126 aa, artificial sequence; identical to SEQ ID NO: 32
  Synthetic Construct

SEQ ID NO: 563 - DNA, 318 bp, artificial sequence; identical to SEQ ID NO: 61
  light chain variable region of antibody clone #22
  CDS (1)..(318)

SEQ ID NO: 564 - protein, 106 aa, artificial sequence; identical to SEQ ID NO: 62
  Synthetic Construct

SEQ ID NO: 565 - DNA, 369 bp, artificial sequence; identical to SEQ ID NO: 63
  heavy chain variable region of antibody clone #22
  CDS (1)..(369)

SEQ ID NO: 566 - protein, 123 aa, artificial sequence; identical to SEQ ID NO: 64
  Synthetic Construct

SEQ ID NO: 567 - DNA, 312 bp, artificial sequence; identical to SEQ ID NO: 65
  light chain variable region of antibody clone #33
  CDS (1)..(312)

SEQ ID NO: 568 - protein, 104 aa, artificial sequence; identical to SEQ ID NO: 66
  Synthetic Construct

SEQ ID NO: 569 - DNA, 354 bp, artificial sequence; identical to SEQ ID NO: 67
  heavy chain variable region of antibody clone #33
  CDS (1)..(354)

SEQ ID NO: 570 - protein, 118 aa, artificial sequence; identical to SEQ ID NO: 68
  Synthetic Construct

SEQ ID NO: 571 - DNA, 966 bp, artificial sequence; identical to SEQ ID NO: 69
  FSTL1 used in Example (human)
  CDS (1)..(966)

SEQ ID NO: 572 - protein, 321 aa, artificial sequence; identical to SEQ ID NO: 70
  Synthetic Construct

SEQ ID NO: 573 - DNA, 960 bp, artificial sequence; identical to SEQ ID NO: 71
  FSTL1 used in Example (mouse)
  CDS (1)..(960)

SEQ ID NO: 574 - protein, 319 aa, artificial sequence; identical to SEQ ID NO: 72
  Synthetic Construct

SEQ ID NO: 575 - DNA, 61 bp, artificial sequence; identical to SEQ ID NO: 73
  MCS sequence

SEQ ID NO: 576 - DNA, 61 bp, artificial sequence; identical to SEQ ID NO: 74
  MCS sequence (complementary strand)

SEQ ID NO: 577 - DNA, 16 bp, artificial sequence
  insert sequence
cgaacccttaagcttg

SEQ ID NO: 578 - DNA, 15 bp, artificial sequence
  insert sequence
cgtggcatctagaca

SEQ ID NO: 579 - DNA, 25 bp, artificial sequence
  delta 21-53 (Forward primer)
tgcatcgagcagtgcaagccccaca

SEQ ID NO: 580 - DNA, 25 bp, artificial sequence
  delta 21-53 (Reverse primer)
ggcgcgcacccaagccacagccacc

SEQ ID NO: 581 - DNA, 25 bp, artificial sequence
  delta 100-140(Forward primer)
aagggcagcaactacagcgagatcc

SEQ ID NO: 582 - DNA, 25 bp, artificial sequence
  delta100-140( Reverse primer)
tttgcagtggccgtcgtagtccacc

SEQ ID NO: 583 - DNA, 25 bp, artificial sequence
  delta 148-170(Forward primer)
ttcgtggaacagaacgagacagcca

SEQ ID NO: 584 - DNA, 25 bp, artificial sequence
  delta 148-170( Reverse primer)
ctcgctgtagttgctgcccttgctg

SEQ ID NO: 585 - DNA, 25 bp, artificial sequence
  delta 181-190(Forward primer)
aagctgctgcggggcctgtgcgtgg

SEQ ID NO: 586 - DNA, 25 bp, artificial sequence
  delta 181-190( Reverse primer)
gttgatggctgtctcgttctgttcc

SEQ ID NO: 587 - DNA, 25 bp, artificial sequence
  delta 193-228(Forward primer)
cccgagaagaagtgcgccctggagg

SEQ ID NO: 588 - DNA, 25 bp, artificial sequence
  delta 193-228( Reverse primer)
cagcttgttgttttcctggtcgggg

SEQ ID NO: 589 - DNA, 25 bp, artificial sequence
  delta 233-289(Forward primer)
ctgcagaagcaccaggaaaccgccg

SEQ ID NO: 590 - DNA, 25 bp, artificial sequence
  delta 233-289( Reverse primer)
cttcttctcgggggggttgaagctg

SEQ ID NO: 591 - DNA, 26 bp, artificial sequence
  delta 148-154(Forward primer)
aacttcgacaacggcgacagcagact

SEQ ID NO: 592 - DNA, 25 bp, artificial sequence
  delta 148-154(Reverse primer)
ctcgctgtagttgctgcccttgctg

SEQ ID NO: 593 - DNA, 25 bp, artificial sequence
  delta 155-162(Forward primer)
ctggacagcagcgagttcctgaagt

SEQ ID NO: 594 - DNA, 25 bp, artificial sequence
  delta 155-162(Reverse primer)
cttgaagtacttgtccaggatctcg

SEQ ID NO: 595 - DNA, 25 bp, artificial sequence
  delta 163-170(Forward primer)
ttcgtggaacagaacgagacagcca

SEQ ID NO: 596 - DNA, 25 bp, artificial sequence
  delta 163-170(Reverse primer)
tctgctgtcgccgttgtcgaagttc

SEQ ID NO: 597 - DNA, 839 bp, artificial sequence; identical to SEQ ID NO: 95
  full length light chain of antibody clone #5-2
  CDS (1)..(48)
  Intron (49)..(173)
  CDS (174)..(836)

SEQ ID NO: 598 - protein, 237 aa, artificial sequence; identical to SEQ ID NO: 96
  Synthetic Construct

SEQ ID NO: 599 - DNA, 1629 bp, artificial sequence; identical to SEQ ID NO: 97
  full length heavy chain of antibody clone #5-2
  CDS (1)..(45)
  Intron (46)..(228)
  CDS (229)..(1626)

SEQ ID NO: 600 - protein, 481 aa, artificial sequence; identical to SEQ ID NO: 98
  Synthetic Construct

SEQ ID NO: 601 - DNA, 833 bp, artificial sequence; identical to SEQ ID NO: 99
  full length light chain of antibody clone #5-3
  CDS (1)..(48)
  Intron (49)..(173)
  CDS (174)..(830)

SEQ ID NO: 602 - protein, 235 aa, artificial sequence; identical to SEQ ID NO: 100
  Synthetic Construct

SEQ ID NO: 603 - DNA, 1629 bp, artificial sequence; identical to SEQ ID NO: 101
  full length heavy chain of antibody clone #5-3
  CDS (1)..(45)
  Intron (46)..(228)
  CDS (229)..(1626)

SEQ ID NO: 604 - protein, 481 aa, artificial sequence; identical to SEQ ID NO: 102
  Synthetic Construct

SEQ ID NO: 605 - DNA, 839 bp, artificial sequence; identical to SEQ ID NO: 95
  full length light chain of antibody clone #5-8
  CDS (1)..(48)
  Intron (49)..(173)
  CDS (174)..(836)

SEQ ID NO: 606 - protein, 237 aa, artificial sequence; identical to SEQ ID NO: 96
  Synthetic Construct

SEQ ID NO: 607 - DNA, 1629 bp, artificial sequence; identical to SEQ ID NO: 105
  full length heavy chain of antibody clone #5-8
  CDS (1)..(45)
  Intron (46)..(228)
  CDS (229)..(1626)

SEQ ID NO: 608 - protein, 481 aa, artificial sequence; identical to SEQ ID NO: 106
  Synthetic Construct

SEQ ID NO: 609 - DNA, 845 bp, artificial sequence; identical to SEQ ID NO: 107
  full length light chain of antibody clone #5-10
  CDS (1)..(48)
  Intron (49)..(173)
  CDS (174)..(842)

SEQ ID NO: 610 - protein, 239 aa, artificial sequence; identical to SEQ ID NO: 108
  Synthetic Construct

SEQ ID NO: 611 - DNA, 1629 bp, artificial sequence; identical to SEQ ID NO: 109
  full length heavy chain of antibody clone #5-10
  CDS (1)..(45)
  Intron (46)..(228)
  CDS (229)..(1626)

SEQ ID NO: 612 - protein, 481 aa, artificial sequence; identical to SEQ ID NO: 110
  Synthetic Construct

SEQ ID NO: 613 - DNA, 839 bp, artificial sequence; identical to SEQ ID NO: 95
  full length light chain of antibody clone #5-43
  CDS (1)..(48)
  Intron (49)..(173)
  CDS (174)..(836)

SEQ ID NO: 614 - protein, 237 aa, artificial sequence; identical to SEQ ID NO: 96
  Synthetic Construct

SEQ ID NO: 615 - DNA, 1629 bp, artificial sequence; identical to SEQ ID NO: 113
  full length heavy chain of antibody clone #5-43
  CDS (1)..(45)
  insert (46)..(228)
  CDS (229)..(1626)

SEQ ID NO: 616 - protein, 481 aa, artificial sequence; identical to SEQ ID NO: 114
  Synthetic Construct

SEQ ID NO: 617 - DNA, 833 bp, artificial sequence; identical to SEQ ID NO: 115
  full length light chain of antibody clone #6-55
  CDS (1)..(48)
  Intron (49)..(173)
  CDS (174)..(830)

SEQ ID NO: 618 - protein, 235 aa, artificial sequence; identical to SEQ ID NO: 116
  Synthetic Construct

SEQ ID NO: 619 - DNA, 1626 bp, artificial sequence; identical to SEQ ID NO: 117
  full length heavy chain of antibody clone #6-55
  CDS (1)..(45)
  Intron (46)..(228)
  CDS (229)..(1623)

SEQ ID NO: 620 - protein, 480 aa, artificial sequence; identical to SEQ ID NO: 118
  Synthetic Construct

SEQ ID NO: 621 - DNA, 833 bp, artificial sequence; identical to SEQ ID NO: 119
  full length light chain of antibody clone #7-34
  CDS (1)..(48)
  Intron (49)..(173)
  CDS (174)..(830)

SEQ ID NO: 622 - protein, 235 aa, artificial sequence; identical to SEQ ID NO: 120
  Synthetic Construct

SEQ ID NO: 623 - DNA, 1626 bp, artificial sequence; identical to SEQ ID NO: 121
  full length heavy chain of antibody clone #7-34
  CDS (1)..(45)
  Intron (46)..(228)
  CDS (229)..(1623)

SEQ ID NO: 624 - protein, 480 aa, artificial sequence; identical to SEQ ID NO: 122
  Synthetic Construct

SEQ ID NO: 625 - DNA, 839 bp, artificial sequence; identical to SEQ ID NO: 123
  full length light chain of antibody clone #8-1
  CDS (1)..(48)
  Intron (49)..(173)
  CDS (174)..(836)

SEQ ID NO: 626 - protein, 237 aa, artificial sequence; identical to SEQ ID NO: 124
  Synthetic Construct

SEQ ID NO: 627 - DNA, 1629 bp, artificial sequence; identical to SEQ ID NO: 125
  full length heavy chain of antibody clone #8-1
  CDS (1)..(45)
  Intron (46)..(228)
  CDS (229)..(1626)

SEQ ID NO: 628 - protein, 481 aa, artificial sequence; identical to SEQ ID NO: 126
  Synthetic Construct

SEQ ID NO: 629 - DNA, 833 bp, artificial sequence; identical to SEQ ID NO: 127
  full length light chain of antibody clone #8-4
  CDS (1)..(48)
  Intron (49)..(173)
  CDS (174)..(830)

SEQ ID NO: 630 - protein, 235 aa, artificial sequence; identical to SEQ ID NO: 128
  Synthetic Construct

SEQ ID NO: 631 - DNA, 1629 bp, artificial sequence; identical to SEQ ID NO: 129
  full length heavy chain of antibody clone #8-4
  CDS (1)..(45)
  Intron (46)..(228)
  CDS (229)..(1626)

SEQ ID NO: 632 - protein, 481 aa, artificial sequence; identical to SEQ ID NO: 130
  Synthetic Construct

SEQ ID NO: 633 - DNA, 839 bp, artificial sequence; identical to SEQ ID NO: 95
  full length light chain of antibody clone #8-7
  CDS (1)..(48)
  Intron (49)..(173)
  CDS (174)..(836)

SEQ ID NO: 634 - protein, 237 aa, artificial sequence; identical to SEQ ID NO: 96
  Synthetic Construct

SEQ ID NO: 635 - DNA, 1629 bp, artificial sequence; identical to SEQ ID NO: 133
  full length heavy chain of antibody clone #8-7
  CDS (1)..(45)
  Intron (46)..(173)
  CDS (229)..(1626)

SEQ ID NO: 636 - protein, 481 aa, artificial sequence; identical to SEQ ID NO: 134
  Synthetic Construct

SEQ ID NO: 637 - DNA, 839 bp, artificial sequence; identical to SEQ ID NO: 135
  full length light chain of antibody clone #8-8
  CDS (1)..(48)
  Intron (49)..(173)
  CDS (174)..(836)

SEQ ID NO: 638 - protein, 237 aa, artificial sequence; identical to SEQ ID NO: 136
  Synthetic Construct

SEQ ID NO: 639 - DNA, 1629 bp, artificial sequence; identical to SEQ ID NO: 137
  full length heavy chain of antibody clone #8-8
  CDS (1)..(45)
  Intron (46)..(228)
  CDS (229)..(1626)

SEQ ID NO: 640 - protein, 481 aa, artificial sequence; identical to SEQ ID NO: 138
  Synthetic Construct

SEQ ID NO: 641 - DNA, 830 bp, artificial sequence; identical to SEQ ID NO: 139
  full length light chain of antibody clone #7
  CDS (1)..(48)
  Intron (49)..(173)
  CDS (174)..(827)
  misc_feature (228)..(228): n is a, c, g, or t
  misc_feature (232)..(233): n is a, c, g, or t

SEQ ID NO: 642 - protein, 234 aa, artificial sequence; identical to SEQ ID NO: 140
  misc_feature (35)..(35): The 'Xaa' at location 35 stands for Lys, Glu, or Gln.
  misc_feature (36)..(36): The 'Xaa' at location 36 stands for Lys, Asn, Arg, Ser, Thr, Ile, or Met.
  Synthetic Construct

SEQ ID NO: 643 - DNA, 1638 bp, artificial sequence; identical to SEQ ID NO: 141
  full length heavy chain of antibody clone #7
  CDS (1)..(45)
  Intron (49)..(228)
  CDS (229)..(1635)

SEQ ID NO: 644 - protein, 484 aa, artificial sequence; identical to SEQ ID NO: 142
  Synthetic Construct

SEQ ID NO: 645 - DNA, 833 bp, artificial sequence; identical to SEQ ID NO: 143
  full length light chain of antibody clone #10
  CDS (1)..(48)
  Intron (49)..(173)
  CDS (174)..(830)

SEQ ID NO: 646 - protein, 235 aa, artificial sequence; identical to SEQ ID NO: 144
  Synthetic Construct

SEQ ID NO: 647 - DNA, 1638 bp, artificial sequence; identical to SEQ ID NO: 145
  full length heavy chain of antibody clone #10
  CDS (1)..(45)
  Intron (46)..(228)
  CDS (229)..(1635)

SEQ ID NO: 648 - protein, 484 aa, artificial sequence; identical to SEQ ID NO: 146
  Synthetic Construct

SEQ ID NO: 649 - DNA, 833 bp, artificial sequence; identical to SEQ ID NO: 147
  full length light chain of antibody clone #13
  CDS (1)..(48)
  Intron (49)..(173)
  CDS (174)..(830)

SEQ ID NO: 650 - protein, 235 aa, artificial sequence; identical to SEQ ID NO: 148
  Synthetic Construct

SEQ ID NO: 651 - DNA, 1626 bp, artificial sequence; identical to SEQ ID NO: 121
  full length heavy chain of antibody clone #13
  CDS (1)..(45)
  Intron (46)..(228)
  CDS (229)..(1623)

SEQ ID NO: 652 - protein, 480 aa, artificial sequence; identical to SEQ ID NO: 122
  Synthetic Construct

SEQ ID NO: 653 - DNA, 839 bp, artificial sequence; identical to SEQ ID NO: 151
  full length light chain of antibody clone #22
  CDS (1)..(48)
  Intron (49)..(173)
  CDS (174)..(836)

SEQ ID NO: 654 - protein, 237 aa, artificial sequence; identical to SEQ ID NO: 152
  Synthetic Construct

SEQ ID NO: 655 - DNA, 1617 bp, artificial sequence; identical to SEQ ID NO: 153
  full length heavy chain of antibody clone #22
  CDS (1)..(45)
  Intron (46)..(228)
  CDS (229)..(1614)

SEQ ID NO: 656 - protein, 477 aa, artificial sequence; identical to SEQ ID NO: 154
  Synthetic Construct

SEQ ID NO: 657 - DNA, 833 bp, artificial sequence; identical to SEQ ID NO: 155
  full length light chain of antibody clone #33
  CDS (1)..(48)
  Intron (49)..(173)
  CDS (174)..(830)

SEQ ID NO: 658 - protein, 235 aa, artificial sequence; identical to SEQ ID NO: 156
  Synthetic Construct

SEQ ID NO: 659 - DNA, 1602 bp, artificial sequence; identical to SEQ ID NO: 157
  full length heavy chain of antibody clone #33
  CDS (1)..(45)
  Intron (46)..(228)
  CDS (229)..(1599)

SEQ ID NO: 660 - protein, 472 aa, artificial sequence; identical to SEQ ID NO: 158
  Synthetic Construct

SEQ ID NO: 661 - protein, 290 aa, artificial sequence; identical to SEQ ID NO: 159
  FSTL1 from Novoprotein

SEQ ID NO: 662 - DNA, 90 bp, artificial sequence; identical to SEQ ID NO: 160
  humanaizedH1-FR1
  CDS (1)..(90)

SEQ ID NO: 663 - protein, 30 aa, artificial sequence; identical to SEQ ID NO: 161
  Synthetic Construct

SEQ ID NO: 664 - DNA, 42 bp, artificial sequence; identical to SEQ ID NO: 162
  humanaizedH1-FR2
  CDS (1)..(42)

SEQ ID NO: 665 - protein, 14 aa, artificial sequence
  Synthetic Construct
WVRQAPGKGLEFVA

SEQ ID NO: 666 - DNA, 96 bp, artificial sequence; identical to SEQ ID NO: 164
  humanaizedH1-FR3
  CDS (1)..(96)

SEQ ID NO: 667 - protein, 32 aa, artificial sequence; identical to SEQ ID NO: 165
  Synthetic Construct

SEQ ID NO: 668 - DNA, 33 bp, artificial sequence; identical to SEQ ID NO: 166
  humanaizedH1-FR4
  CDS (1)..(33)

SEQ ID NO: 669 - protein, 11 aa, artificial sequence
  Synthetic Construct
WGQGTLVTVSS

SEQ ID NO: 670 - DNA, 90 bp, artificial sequence; identical to SEQ ID NO: 160
  humanaizedH2-FR1
  CDS (1)..(90)

SEQ ID NO: 671 - protein, 30 aa, artificial sequence; identical to SEQ ID NO: 161
  Synthetic Construct

SEQ ID NO: 672 - DNA, 42 bp, artificial sequence; identical to SEQ ID NO: 170
  humanaizedH2-FR2
  CDS (1)..(42)

SEQ ID NO: 673 - protein, 14 aa, artificial sequence
  Synthetic Construct
WVRQAPGKGLEFVS

SEQ ID NO: 674 - DNA, 96 bp, artificial sequence; identical to SEQ ID NO: 172
  humanaizedH2-FR3
  CDS (1)..(96)

SEQ ID NO: 675 - protein, 32 aa, artificial sequence; identical to SEQ ID NO: 173
  Synthetic Construct

SEQ ID NO: 676 - DNA, 33 bp, artificial sequence; identical to SEQ ID NO: 174
  humanaizedH2-FR4
  CDS (1)..(33)

SEQ ID NO: 677 - protein, 11 aa, artificial sequence
  Synthetic Construct
WGQGTLVTVSS

SEQ ID NO: 678 - DNA, 90 bp, artificial sequence; identical to SEQ ID NO: 160
  humanaizedH3-FR1
  CDS (1)..(90)

SEQ ID NO: 679 - protein, 30 aa, artificial sequence; identical to SEQ ID NO: 161
  Synthetic Construct

SEQ ID NO: 680 - DNA, 42 bp, artificial sequence; identical to SEQ ID NO: 162
  humanaizedH3-FR2
  CDS (1)..(42)

SEQ ID NO: 681 - protein, 14 aa, artificial sequence
  Synthetic Construct
WVRQAPGKGLEFVA

SEQ ID NO: 682 - DNA, 96 bp, artificial sequence; identical to SEQ ID NO: 180
  humanaizedH3-FR3
  CDS (1)..(96)

SEQ ID NO: 683 - protein, 32 aa, artificial sequence; identical to SEQ ID NO: 181
  Synthetic Construct

SEQ ID NO: 684 - DNA, 33 bp, artificial sequence; identical to SEQ ID NO: 166
  humanaizedH3-FR4
  CDS (1)..(33)

SEQ ID NO: 685 - protein, 11 aa, artificial sequence
  Synthetic Construct
WGQGTLVTVSS

SEQ ID NO: 686 - DNA, 66 bp, artificial sequence; identical to SEQ ID NO: 184
  humanaizedL1-FR1
  CDS (1)..(66)

SEQ ID NO: 687 - protein, 22 aa, artificial sequence
  Synthetic Construct
SYELTQPPSVSVSPGQTARITC

SEQ ID NO: 688 - DNA, 45 bp, artificial sequence; identical to SEQ ID NO: 186
  humanaizedL1-FR2
  CDS (1)..(45)

SEQ ID NO: 689 - protein, 15 aa, artificial sequence
  Synthetic Construct
WYQQKPGQAPVTVIY

SEQ ID NO: 690 - DNA, 96 bp, artificial sequence; identical to SEQ ID NO: 188
  humanaizedL1-FR3
  CDS (1)..(96)

SEQ ID NO: 691 - protein, 32 aa, artificial sequence; identical to SEQ ID NO: 189
  Synthetic Construct

SEQ ID NO: 692 - DNA, 30 bp, artificial sequence; identical to SEQ ID NO: 190
  humanaizedL1-FR4
  CDS (1)..(30)

SEQ ID NO: 693 - protein, 10 aa, artificial sequence
  Synthetic Construct
FGGGTKLTVL

SEQ ID NO: 694 - DNA, 1425 bp, artificial sequence; identical to SEQ ID NO: 192
  humanized-IgG1-H1-complete
  CDS (1)..(1425)
  sig_peptide (1)..(54)

SEQ ID NO: 695 - protein, 474 aa, artificial sequence; identical to SEQ ID NO: 193
  Synthetic Construct

SEQ ID NO: 696 - DNA, 1425 bp, artificial sequence; identical to SEQ ID NO: 194
  humanized-IgG1-H2-complete
  CDS (1)..(1425)
  sig_peptide (1)..(54)

SEQ ID NO: 697 - protein, 474 aa, artificial sequence; identical to SEQ ID NO: 195
  Synthetic Construct

SEQ ID NO: 698 - DNA, 1425 bp, artificial sequence; identical to SEQ ID NO: 196
  humanized-IgG1-H3-complete
  CDS (1)..(1425)
  sig_peptide (1)..(54)

SEQ ID NO: 699 - protein, 474 aa, artificial sequence; identical to SEQ ID NO: 197
  Synthetic Construct

SEQ ID NO: 700 - DNA, 1416 bp, artificial sequence; identical to SEQ ID NO: 198
  humanized-IgG4-H1-complete
  CDS (1)..(1416)
  sig_peptide (1)..(54)

SEQ ID NO: 701 - protein, 471 aa, artificial sequence; identical to SEQ ID NO: 199
  Synthetic Construct

SEQ ID NO: 702 - DNA, 1416 bp, artificial sequence; identical to SEQ ID NO: 200
  humanized-IgG4-H2-complete
  CDS (1)..(1416)
  sig_peptide (1)..(54)

SEQ ID NO: 703 - protein, 471 aa, artificial sequence; identical to SEQ ID NO: 201
  Synthetic Construct

SEQ ID NO: 704 - DNA, 1416 bp, artificial sequence; identical to SEQ ID NO: 202
  humanized-IgG4-H3-complete
  CDS (1)..(1416)
  sig_peptide (1)..(54)

SEQ ID NO: 705 - protein, 471 aa, artificial sequence; identical to SEQ ID NO: 203
  Synthetic Construct

SEQ ID NO: 706 - DNA, 693 bp, artificial sequence; identical to SEQ ID NO: 204
  humanized-L1-complete
  CDS (1)..(693)
  sig_peptide (1)..(54)

SEQ ID NO: 707 - protein, 230 aa, artificial sequence; identical to SEQ ID NO: 205
  Synthetic Construct

SEQ ID NO: 708 - protein, 30 aa, artificial sequence; identical to SEQ ID NO: 206
  chicken-Heavy-FR1-for-reference

SEQ ID NO: 709 - protein, 14 aa, artificial sequence
  chicken-Heavy-FR2-for-reference
WVRQAPGKGLEWVA

SEQ ID NO: 710 - protein, 32 aa, artificial sequence; identical to SEQ ID NO: 208
  chicken-Heavy-FR3-for-reference

SEQ ID NO: 711 - protein, 11 aa, artificial sequence
  chicken-Heavy-FR4-for-reference
WGHGTEVIVSP

SEQ ID NO: 712 - protein, 20 aa, artificial sequence
  chicken-Light-FR1-for-reference
ASTQPSSVSANPGETVKITC

SEQ ID NO: 713 - protein, 16 aa, artificial sequence
  chicken-Light-FR2-for-reference
WYQQKSPGSAPVTVIY

SEQ ID NO: 714 - protein, 32 aa, artificial sequence; identical to SEQ ID NO: 212
  chicken-Light-FR3-for-reference

SEQ ID NO: 715 - protein, 10 aa, artificial sequence
  chicken-Light-FR4-for-reference
FGAGTTLTVL

SEQ ID NO: 716 - protein, 16 aa, artificial sequence
  chicken-alternative-Light-FR2-for-reference
WYQQKSPGSAPVTVIY

SEQ ID NO: 717 - protein, 10 aa, artificial sequence
  chicken-alternative-Light-FR3-for-reference
FGAGTTLTVL

SEQ ID NO: 718 - DNA, 21 bp, artificial sequence
  delta 193-204 (Forward primer)
agcgacgagaacgccgactgg

SEQ ID NO: 719 - DNA, 25 bp, artificial sequence
  delta 193-204 (Reverse primer)
cagcttgttgttttcctggtcgggg

SEQ ID NO: 720 - DNA, 21 bp, artificial sequence
  delta 205-216 (Forward primer)
gaatttctgaagtgcctgaac

SEQ ID NO: 721 - DNA, 21 bp, artificial sequence
  delta 205-216 (Reverse primer)
cagctcaatcagggcgtccac

SEQ ID NO: 722 - DNA, 25 bp, artificial sequence
  delta 217-228 (Forward primer)
cccgagaagaagtgcgccctggagg

SEQ ID NO: 723 - DNA, 21 bp, artificial sequence
  delta 217-228 (Reverse primer)
ctgaaagctcagcttccagtc

SEQ ID NO: 724 - DNA, 21 bp, artificial sequence
  delta 233-251 (Forward primer)
agatgcgtgtgcgcctgcggc

SEQ ID NO: 725 - DNA, 25 bp, artificial sequence
  delta 233-251 (Reverse primer)
cttcttctcgggggggttgaagctg

SEQ ID NO: 726 - DNA, 21 bp, artificial sequence
  delta 252-270 (Forward primer)
aatcagaagggcgcccagacc

SEQ ID NO: 727 - DNA, 22 bp, artificial sequence
  delta 252-270 (Reverse primer)
gttgcagtccacctctgtctcg

SEQ ID NO: 728 - DNA, 25 bp, artificial sequence
  delta 271-289 (Forward primer)
cttcttctcgggggggttgaagctg

SEQ ID NO: 729 - DNA, 22 bp, artificial sequence
  delta 271-289 (Reverse primer)
cttgccgtcgcaggtcatggcg

SEQ ID NO: 730 - DNA, 21 bp, artificial sequence
  delta 48-100 (Forward primer)
aagaaaagcgtgtcccccagc

SEQ ID NO: 731 - DNA, 21 bp, artificial sequence
  delta 48-100 (Reverse primer)
cttctcggtcacggcacattc

SEQ ID NO: 732 - DNA, 66 bp, artificial sequence; identical to SEQ ID NO: 184
  humanizedL2-FR1
  CDS (1)..(66)

SEQ ID NO: 733 - protein, 22 aa, artificial sequence
  Synthetic Construct
SYELTQPPSVSVSPGQTARITC

SEQ ID NO: 734 - DNA, 45 bp, artificial sequence; identical to SEQ ID NO: 186
  humanizedL2-FR2
  CDS (1)..(45)

SEQ ID NO: 735 - protein, 15 aa, artificial sequence
  Synthetic Construct
WYQQKPGQAPVTVIY

SEQ ID NO: 736 - DNA, 96 bp, artificial sequence; identical to SEQ ID NO: 234
  humanizedL2-FR3
  CDS (1)..(96)

SEQ ID NO: 737 - protein, 32 aa, artificial sequence; identical to SEQ ID NO: 235
  Synthetic Construct

SEQ ID NO: 738 - DNA, 30 bp, artificial sequence; identical to SEQ ID NO: 190
  humanizedL2-FR4
  CDS (1)..(30)

SEQ ID NO: 739 - protein, 10 aa, artificial sequence
  Synthetic Construct
FGGGTKLTVL

SEQ ID NO: 740 - DNA, 66 bp, artificial sequence; identical to SEQ ID NO: 184
  humanizedL3-FR1
  CDS (1)..(66)

SEQ ID NO: 741 - protein, 22 aa, artificial sequence
  Synthetic Construct
SYELTQPPSVSVSPGQTARITC

SEQ ID NO: 742 - DNA, 45 bp, artificial sequence; identical to SEQ ID NO: 186
  humanizedL3-FR2
  CDS (1)..(45)

SEQ ID NO: 743 - protein, 15 aa, artificial sequence
  Synthetic Construct
WYQQKPGQAPVTVIY

SEQ ID NO: 744 - DNA, 96 bp, artificial sequence; identical to SEQ ID NO: 242
  humanizedL3-FR3
  CDS (1)..(96)

SEQ ID NO: 745 - protein, 32 aa, artificial sequence; identical to SEQ ID NO: 243
  Synthetic Construct

SEQ ID NO: 746 - DNA, 30 bp, artificial sequence; identical to SEQ ID NO: 190
  humanizedL3-FR4
  CDS (1)..(30)

SEQ ID NO: 747 - protein, 10 aa, artificial sequence
  Synthetic Construct
FGGGTKLTVL

SEQ ID NO: 748 - DNA, 693 bp, artificial sequence; identical to SEQ ID NO: 246
  humanizedL2-complete
  CDS (1)..(693)
  sig_peptide (1)..(54)

SEQ ID NO: 749 - protein, 230 aa, artificial sequence; identical to SEQ ID NO: 247
  Synthetic Construct

SEQ ID NO: 750 - DNA, 693 bp, artificial sequence; identical to SEQ ID NO: 248
  humanizedL3-complete
  CDS (1)..(693)
  sig_peptide (1)..(54)

SEQ ID NO: 751 - protein, 230 aa, artificial sequence; identical to SEQ ID NO: 249
  Synthetic Construct

SEQ ID NO: 752 - DNA, 669 bp, Homo sapiens
  CDS (1)..(669)
  sig_peptide (1)..(105)
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaat

SEQ ID NO: 753 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 754 - DNA, 669 bp, Mus musculus
  CDS (1)..(669)
  sig_peptide (1)..(105)
atggcttgtcttggactccggaggtacaaagctcaactgcagctgccttctaggacttggccttttgtagccctgctcactcttcttttcatcccagtcttctctgaagccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgacttcctcctttggatccttgtcgcagttagcttggggttgtttttttacagtttcctggtcactgctgtttctttgagcaagatgctaaagaaaagaagtcctcttacaacaggggtctatgtgaaaatgcccccaacagagccagaatgtgaaaagcaatttcagccttattttattcccatcaac

SEQ ID NO: 755 - protein, 223 aa, Mus musculus
MACLGLRRYKAQLQLPSRTWPFVALLTLLFIPVFSEAIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDFLLWILVAVSLGLFFYSFLVTAVSLSKMLKKRSPLTTGVYVKMPPTEPECEKQFQPYFIPIN

SEQ ID NO: 756 - protein, 448 aa, artificial sequence
  ipilimumab-Heavy-complete
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 757 - protein, 215 aa, artificial sequence
  ipilimumab-Light-complete
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 758 - DNA, 927 bp, homo sapiens; identical to SEQ ID NO: 1
  CDS (1)..(927)
  sig_peptide (1)..(60)

SEQ ID NO: 759 - protein, 308 aa, homo sapiens; identical to SEQ ID NO: 2

SEQ ID NO: 760 - DNA, 921 bp, Mus musculus; identical to SEQ ID NO: 3
  CDS (1)..(921)
  sig_peptide (1)..(54)

SEQ ID NO: 761 - protein, 306 aa, Mus musculus; identical to SEQ ID NO: 4

SEQ ID NO: 762 - DNA, 318 bp, artificial sequence; identical to SEQ ID NO: 5
  light chain variable region of antibody clone #5-2
  CDS (1)..(318)

SEQ ID NO: 763 - protein, 106 aa, artificial sequence; identical to SEQ ID NO: 6
  Synthetic Construct

SEQ ID NO: 764 - DNA, 381 bp, artificial sequence; identical to SEQ ID NO: 7
  heavy chain variable region of antibody clone #5-2
  CDS (1)..(381)

SEQ ID NO: 765 - protein, 127 aa, artificial sequence; identical to SEQ ID NO: 8
  Synthetic Construct

SEQ ID NO: 766 - DNA, 312 bp, artificial sequence; identical to SEQ ID NO: 9
  light chain variable region of antibody clone #5-3
  CDS (1)..(312)

SEQ ID NO: 767 - protein, 104 aa, artificial sequence; identical to SEQ ID NO: 10
  Synthetic Construct

SEQ ID NO: 768 - DNA, 381 bp, artificial sequence; identical to SEQ ID NO: 11
  heavy chain variable region of antibody clone #5-3
  CDS (1)..(381)

SEQ ID NO: 769 - protein, 127 aa, artificial sequence; identical to SEQ ID NO: 12
  Synthetic Construct

SEQ ID NO: 770 - DNA, 318 bp, artificial sequence; identical to SEQ ID NO: 5
  light chain variable region of antibody clone #5-8
  CDS (1)..(318)

SEQ ID NO: 771 - protein, 106 aa, artificial sequence; identical to SEQ ID NO: 6
  Synthetic Construct

SEQ ID NO: 772 - DNA, 381 bp, artificial sequence; identical to SEQ ID NO: 15
  heavy chain variable region of antibody clone #5-8
  CDS (1)..(381)

SEQ ID NO: 773 - protein, 127 aa, artificial sequence; identical to SEQ ID NO: 16
  Synthetic Construct

SEQ ID NO: 774 - DNA, 324 bp, artificial sequence; identical to SEQ ID NO: 17
  light chain variable region of antibody clone #5-10
  CDS (1)..(324)

SEQ ID NO: 775 - protein, 108 aa, artificial sequence; identical to SEQ ID NO: 18
  Synthetic Construct

SEQ ID NO: 776 - DNA, 381 bp, artificial sequence; identical to SEQ ID NO: 19
  heavy chain variable region of antibody clone #5-10
  CDS (1)..(381)

SEQ ID NO: 777 - protein, 127 aa, artificial sequence; identical to SEQ ID NO: 20
  Synthetic Construct

SEQ ID NO: 778 - DNA, 318 bp, artificial sequence; identical to SEQ ID NO: 5
  light chain variable region of antibody clone #5-43
  CDS (1)..(318)

SEQ ID NO: 779 - protein, 106 aa, artificial sequence; identical to SEQ ID NO: 6
  Synthetic Construct

SEQ ID NO: 780 - DNA, 381 bp, artificial sequence; identical to SEQ ID NO: 23
  heavy chain variable region of antibody clone #5-43
  CDS (1)..(381)

SEQ ID NO: 781 - protein, 127 aa, artificial sequence; identical to SEQ ID NO: 24
  Synthetic Construct

SEQ ID NO: 782 - DNA, 312 bp, artificial sequence; identical to SEQ ID NO: 25
  light chain variable region of antibody clone #6-55
  CDS (1)..(312)

SEQ ID NO: 783 - protein, 104 aa, artificial sequence; identical to SEQ ID NO: 26
  Synthetic Construct

SEQ ID NO: 784 - DNA, 378 bp, artificial sequence; identical to SEQ ID NO: 27
  heavy chain variable region of antibody clone #6-55
  CDS (1)..(378)

SEQ ID NO: 785 - protein, 126 aa, artificial sequence; identical to SEQ ID NO: 28
  Synthetic Construct

SEQ ID NO: 786 - DNA, 312 bp, artificial sequence; identical to SEQ ID NO: 29
  light chain variable region of antibody clone #7-34
  CDS (1)..(312)

SEQ ID NO: 787 - protein, 104 aa, artificial sequence; identical to SEQ ID NO: 30
  Synthetic Construct

SEQ ID NO: 788 - DNA, 378 bp, artificial sequence; identical to SEQ ID NO: 31
  heavy chain variable region of antibody clone #7-34
  CDS (1)..(378)

SEQ ID NO: 789 - protein, 126 aa, artificial sequence; identical to SEQ ID NO: 32
  Synthetic Construct

SEQ ID NO: 790 - DNA, 318 bp, artificial sequence; identical to SEQ ID NO: 33
  light chain variable region of antibody clone #8-1
  CDS (1)..(318)

SEQ ID NO: 791 - protein, 106 aa, artificial sequence; identical to SEQ ID NO: 34
  Synthetic Construct

SEQ ID NO: 792 - DNA, 381 bp, artificial sequence; identical to SEQ ID NO: 35
  heavy chain variable region of antibody clone #8-1
  CDS (1)..(381)

SEQ ID NO: 793 - protein, 127 aa, artificial sequence; identical to SEQ ID NO: 36
  Synthetic Construct

SEQ ID NO: 794 - DNA, 312 bp, artificial sequence; identical to SEQ ID NO: 37
  light chain variable region of antibody clone #8-4
  CDS (1)..(312)

SEQ ID NO: 795 - protein, 104 aa, artificial sequence; identical to SEQ ID NO: 38
  Synthetic Construct

SEQ ID NO: 796 - DNA, 381 bp, artificial sequence; identical to SEQ ID NO: 39
  heavy chain variable region of antibody clone #8-4
  CDS (1)..(381)

SEQ ID NO: 797 - protein, 127 aa, artificial sequence; identical to SEQ ID NO: 40
  Synthetic Construct

SEQ ID NO: 798 - DNA, 318 bp, artificial sequence; identical to SEQ ID NO: 5
  light chain variable region of antibody clone #8-7
  CDS (1)..(318)

SEQ ID NO: 799 - protein, 106 aa, artificial sequence; identical to SEQ ID NO: 6
  Synthetic Construct

SEQ ID NO: 800 - DNA, 381 bp, artificial sequence; identical to SEQ ID NO: 43
  heavy chain variable region of antibody clone #8-7
  CDS (1)..(381)

SEQ ID NO: 801 - protein, 127 aa, artificial sequence; identical to SEQ ID NO: 44
  Synthetic Construct

SEQ ID NO: 802 - DNA, 318 bp, artificial sequence; identical to SEQ ID NO: 45
  light chain variable region of antibody clone #8-8
  CDS (1)..(318)

SEQ ID NO: 803 - protein, 106 aa, artificial sequence; identical to SEQ ID NO: 46
  Synthetic Construct

SEQ ID NO: 804 - DNA, 381 bp, artificial sequence; identical to SEQ ID NO: 47
  heavy chain variable region of antibody clone #8-8
  CDS (1)..(381)

SEQ ID NO: 805 - protein, 127 aa, artificial sequence; identical to SEQ ID NO: 48
  Synthetic Construct

SEQ ID NO: 806 - DNA, 309 bp, artificial sequence; identical to SEQ ID NO: 49
  light chain variable region of antibody clone #7
  CDS (1)..(309)
  misc_feature (40)..(40): n is a, c, g, or t
  misc_feature (44)..(45): n is a, c, g, or t

SEQ ID NO: 807 - protein, 103 aa, artificial sequence; identical to SEQ ID NO: 50
  misc_feature (14)..(14): The 'Xaa' at location 14 stands for Lys, Glu, or Gln.
  misc_feature (15)..(15): The 'Xaa' at location 15 stands for Lys, Asn, Arg, Ser, Thr, Ile, or Met.
  Synthetic Construct

SEQ ID NO: 808 - DNA, 390 bp, artificial sequence; identical to SEQ ID NO: 51
  heavy chain variable region of antibody clone #7
  CDS (1)..(390)

SEQ ID NO: 809 - protein, 130 aa, artificial sequence; identical to SEQ ID NO: 52
  Synthetic Construct

SEQ ID NO: 810 - DNA, 312 bp, artificial sequence; identical to SEQ ID NO: 53
  light chain variable region of antibody clone #10
  CDS (1)..(312)

SEQ ID NO: 811 - protein, 104 aa, artificial sequence; identical to SEQ ID NO: 54
  Synthetic Construct

SEQ ID NO: 812 - DNA, 390 bp, artificial sequence; identical to SEQ ID NO: 55
  heavy chain variable region of antibody clone #10
  CDS (1)..(390)

SEQ ID NO: 813 - protein, 130 aa, artificial sequence; identical to SEQ ID NO: 56
  Synthetic Construct

SEQ ID NO: 814 - DNA, 312 bp, artificial sequence; identical to SEQ ID NO: 57
  light chain variable region of antibody clone #13
  CDS (1)..(312)

SEQ ID NO: 815 - protein, 104 aa, artificial sequence; identical to SEQ ID NO: 58
  Synthetic Construct

SEQ ID NO: 816 - DNA, 378 bp, artificial sequence; identical to SEQ ID NO: 31
  heavy chain variable region of antibody clone #13
  CDS (1)..(378)

SEQ ID NO: 817 - protein, 126 aa, artificial sequence; identical to SEQ ID NO: 32
  Synthetic Construct

SEQ ID NO: 818 - DNA, 318 bp, artificial sequence; identical to SEQ ID NO: 61
  light chain variable region of antibody clone #22
  CDS (1)..(318)

SEQ ID NO: 819 - protein, 106 aa, artificial sequence; identical to SEQ ID NO: 62
  Synthetic Construct

SEQ ID NO: 820 - DNA, 369 bp, artificial sequence; identical to SEQ ID NO: 63
  heavy chain variable region of antibody clone #22
  CDS (1)..(369)

SEQ ID NO: 821 - protein, 123 aa, artificial sequence; identical to SEQ ID NO: 64
  Synthetic Construct

SEQ ID NO: 822 - DNA, 312 bp, artificial sequence; identical to SEQ ID NO: 65
  light chain variable region of antibody clone #33
  CDS (1)..(312)

SEQ ID NO: 823 - protein, 104 aa, artificial sequence; identical to SEQ ID NO: 66
  Synthetic Construct

SEQ ID NO: 824 - DNA, 354 bp, artificial sequence; identical to SEQ ID NO: 67
  heavy chain variable region of antibody clone #33
  CDS (1)..(354)

SEQ ID NO: 825 - protein, 118 aa, artificial sequence; identical to SEQ ID NO: 68
  Synthetic Construct

SEQ ID NO: 826 - DNA, 966 bp, artificial sequence; identical to SEQ ID NO: 69
  FSTL1 used in Example (human)
  CDS (1)..(966)

SEQ ID NO: 827 - protein, 321 aa, artificial sequence; identical to SEQ ID NO: 70
  Synthetic Construct

SEQ ID NO: 828 - DNA, 960 bp, artificial sequence; identical to SEQ ID NO: 71
  FSTL1 used in Example (mouse)
  CDS (1)..(960)

SEQ ID NO: 829 - protein, 319 aa, artificial sequence; identical to SEQ ID NO: 72
  Synthetic Construct

SEQ ID NO: 830 - DNA, 61 bp, artificial sequence; identical to SEQ ID NO: 73
  MCS sequence

SEQ ID NO: 831 - DNA, 61 bp, artificial sequence; identical to SEQ ID NO: 74
  MCS sequence (complementary strand)

SEQ ID NO: 832 - DNA, 16 bp, artificial sequence
  insert sequence
cgaacccttaagcttg

SEQ ID NO: 833 - DNA, 15 bp, artificial sequence
  insert sequence
cgtggcatctagaca

SEQ ID NO: 834 - DNA, 25 bp, artificial sequence
  delta 21-53 (Forward primer)
tgcatcgagcagtgcaagccccaca

SEQ ID NO: 835 - DNA, 25 bp, artificial sequence
  delta 21-53 (Reverse primer)
ggcgcgcacccaagccacagccacc

SEQ ID NO: 836 - DNA, 25 bp, artificial sequence
  delta 100-140(Forward primer)
aagggcagcaactacagcgagatcc

SEQ ID NO: 837 - DNA, 25 bp, artificial sequence
  delta100-140( Reverse primer)
tttgcagtggccgtcgtagtccacc

SEQ ID NO: 838 - DNA, 25 bp, artificial sequence
  delta 148-170(Forward primer)
ttcgtggaacagaacgagacagcca

SEQ ID NO: 839 - DNA, 25 bp, artificial sequence
  delta 148-170( Reverse primer)
ctcgctgtagttgctgcccttgctg

SEQ ID NO: 840 - DNA, 25 bp, artificial sequence
  delta 181-190(Forward primer)
aagctgctgcggggcctgtgcgtgg

SEQ ID NO: 841 - DNA, 25 bp, artificial sequence
  delta 181-190( Reverse primer)
gttgatggctgtctcgttctgttcc

SEQ ID NO: 842 - DNA, 25 bp, artificial sequence
  delta 193-228(Forward primer)
cccgagaagaagtgcgccctggagg

SEQ ID NO: 843 - DNA, 25 bp, artificial sequence
  delta 193-228( Reverse primer)
cagcttgttgttttcctggtcgggg

SEQ ID NO: 844 - DNA, 25 bp, artificial sequence
  delta 233-289(Forward primer)
ctgcagaagcaccaggaaaccgccg

SEQ ID NO: 845 - DNA, 25 bp, artificial sequence
  delta 233-289( Reverse primer)
cttcttctcgggggggttgaagctg

SEQ ID NO: 846 - DNA, 26 bp, artificial sequence
  delta 148-154(Forward primer)
aacttcgacaacggcgacagcagact

SEQ ID NO: 847 - DNA, 25 bp, artificial sequence
  delta 148-154(Reverse primer)
ctcgctgtagttgctgcccttgctg

SEQ ID NO: 848 - DNA, 25 bp, artificial sequence
  delta 155-162(Forward primer)
ctggacagcagcgagttcctgaagt

SEQ ID NO: 849 - DNA, 25 bp, artificial sequence
  delta 155-162(Reverse primer)
cttgaagtacttgtccaggatctcg

SEQ ID NO: 850 - DNA, 25 bp, artificial sequence
  delta 163-170(Forward primer)
ttcgtggaacagaacgagacagcca

SEQ ID NO: 851 - DNA, 25 bp, artificial sequence
  delta 163-170(Reverse primer)
tctgctgtcgccgttgtcgaagttc

SEQ ID NO: 852 - DNA, 839 bp, artificial sequence; identical to SEQ ID NO: 95
  full length light chain of antibody clone #5-2
  CDS (1)..(48)
  Intron (49)..(173)
  CDS (174)..(836)

SEQ ID NO: 853 - protein, 237 aa, artificial sequence; identical to SEQ ID NO: 96
  Synthetic Construct

SEQ ID NO: 854 - DNA, 1629 bp, artificial sequence; identical to SEQ ID NO: 97
  full length heavy chain of antibody clone #5-2
  CDS (1)..(45)
  Intron (46)..(228)
  CDS (229)..(1626)

SEQ ID NO: 855 - protein, 481 aa, artificial sequence; identical to SEQ ID NO: 98
  Synthetic Construct

SEQ ID NO: 856 - DNA, 833 bp, artificial sequence; identical to SEQ ID NO: 99
  full length light chain of antibody clone #5-3
  CDS (1)..(48)
  Intron (49)..(173)
  CDS (174)..(830)

SEQ ID NO: 857 - protein, 235 aa, artificial sequence; identical to SEQ ID NO: 100
  Synthetic Construct

SEQ ID NO: 858 - DNA, 1629 bp, artificial sequence; identical to SEQ ID NO: 101
  full length heavy chain of antibody clone #5-3
  CDS (1)..(45)
  Intron (46)..(228)
  CDS (229)..(1626)

SEQ ID NO: 859 - protein, 481 aa, artificial sequence; identical to SEQ ID NO: 102
  Synthetic Construct

SEQ ID NO: 860 - DNA, 839 bp, artificial sequence; identical to SEQ ID NO: 95
  full length light chain of antibody clone #5-8
  CDS (1)..(48)
  Intron (49)..(173)
  CDS (174)..(836)

SEQ ID NO: 861 - protein, 237 aa, artificial sequence; identical to SEQ ID NO: 96
  Synthetic Construct

SEQ ID NO: 862 - DNA, 1629 bp, artificial sequence; identical to SEQ ID NO: 105
  full length heavy chain of antibody clone #5-8
  CDS (1)..(45)
  Intron (46)..(228)
  CDS (229)..(1626)

SEQ ID NO: 863 - protein, 481 aa, artificial sequence; identical to SEQ ID NO: 106
  Synthetic Construct

SEQ ID NO: 864 - DNA, 845 bp, artificial sequence; identical to SEQ ID NO: 107
  full length light chain of antibody clone #5-10
  CDS (1)..(48)
  Intron (49)..(173)
  CDS (174)..(842)

SEQ ID NO: 865 - protein, 239 aa, artificial sequence; identical to SEQ ID NO: 108
  Synthetic Construct

SEQ ID NO: 866 - DNA, 1629 bp, artificial sequence; identical to SEQ ID NO: 109
  full length heavy chain of antibody clone #5-10
  CDS (1)..(45)
  Intron (46)..(228)
  CDS (229)..(1626)

SEQ ID NO: 867 - protein, 481 aa, artificial sequence; identical to SEQ ID NO: 110
  Synthetic Construct

SEQ ID NO: 868 - DNA, 839 bp, artificial sequence; identical to SEQ ID NO: 95
  full length light chain of antibody clone #5-43
  CDS (1)..(48)
  Intron (49)..(173)
  CDS (174)..(836)

SEQ ID NO: 869 - protein, 237 aa, artificial sequence; identical to SEQ ID NO: 96
  Synthetic Construct

SEQ ID NO: 870 - DNA, 1629 bp, artificial sequence; identical to SEQ ID NO: 113
  full length heavy chain of antibody clone #5-43
  CDS (1)..(45)
  insert (46)..(228)
  CDS (229)..(1626)

SEQ ID NO: 871 - protein, 481 aa, artificial sequence; identical to SEQ ID NO: 114
  Synthetic Construct

SEQ ID NO: 872 - DNA, 833 bp, artificial sequence; identical to SEQ ID NO: 115
  full length light chain of antibody clone #6-55
  CDS (1)..(48)
  Intron (49)..(173)
  CDS (174)..(830)

SEQ ID NO: 873 - protein, 235 aa, artificial sequence; identical to SEQ ID NO: 116
  Synthetic Construct

SEQ ID NO: 874 - DNA, 1626 bp, artificial sequence; identical to SEQ ID NO: 117
  full length heavy chain of antibody clone #6-55
  CDS (1)..(45)
  Intron (46)..(228)
  CDS (229)..(1623)

SEQ ID NO: 875 - protein, 480 aa, artificial sequence; identical to SEQ ID NO: 118
  Synthetic Construct

SEQ ID NO: 876 - DNA, 833 bp, artificial sequence; identical to SEQ ID NO: 119
  full length light chain of antibody clone #7-34
  CDS (1)..(48)
  Intron (49)..(173)
  CDS (174)..(830)

SEQ ID NO: 877 - protein, 235 aa, artificial sequence; identical to SEQ ID NO: 120
  Synthetic Construct

SEQ ID NO: 878 - DNA, 1626 bp, artificial sequence; identical to SEQ ID NO: 121
  full length heavy chain of antibody clone #7-34
  CDS (1)..(45)
  Intron (46)..(228)
  CDS (229)..(1623)

SEQ ID NO: 879 - protein, 480 aa, artificial sequence; identical to SEQ ID NO: 122
  Synthetic Construct

SEQ ID NO: 880 - DNA, 839 bp, artificial sequence; identical to SEQ ID NO: 123
  full length light chain of antibody clone #8-1
  CDS (1)..(48)
  Intron (49)..(173)
  CDS (174)..(836)

SEQ ID NO: 881 - protein, 237 aa, artificial sequence; identical to SEQ ID NO: 124
  Synthetic Construct

SEQ ID NO: 882 - DNA, 1629 bp, artificial sequence; identical to SEQ ID NO: 125
  full length heavy chain of antibody clone #8-1
  CDS (1)..(45)
  Intron (46)..(228)
  CDS (229)..(1626)

SEQ ID NO: 883 - protein, 481 aa, artificial sequence; identical to SEQ ID NO: 126
  Synthetic Construct

SEQ ID NO: 884 - DNA, 833 bp, artificial sequence; identical to SEQ ID NO: 127
  full length light chain of antibody clone #8-4
  CDS (1)..(48)
  Intron (49)..(173)
  CDS (174)..(830)

SEQ ID NO: 885 - protein, 235 aa, artificial sequence; identical to SEQ ID NO: 128
  Synthetic Construct

SEQ ID NO: 886 - DNA, 1629 bp, artificial sequence; identical to SEQ ID NO: 129
  full length heavy chain of antibody clone #8-4
  CDS (1)..(45)
  Intron (46)..(228)
  CDS (229)..(1626)

SEQ ID NO: 887 - protein, 481 aa, artificial sequence; identical to SEQ ID NO: 130
  Synthetic Construct

SEQ ID NO: 888 - DNA, 839 bp, artificial sequence; identical to SEQ ID NO: 95
  full length light chain of antibody clone #8-7
  CDS (1)..(48)
  Intron (49)..(173)
  CDS (174)..(836)

SEQ ID NO: 889 - protein, 237 aa, artificial sequence; identical to SEQ ID NO: 96
  Synthetic Construct

SEQ ID NO: 890 - DNA, 1629 bp, artificial sequence; identical to SEQ ID NO: 133
  full length heavy chain of antibody clone #8-7
  CDS (1)..(45)
  Intron (46)..(173)
  CDS (229)..(1626)

SEQ ID NO: 891 - protein, 481 aa, artificial sequence; identical to SEQ ID NO: 134
  Synthetic Construct

SEQ ID NO: 892 - DNA, 839 bp, artificial sequence; identical to SEQ ID NO: 135
  full length light chain of antibody clone #8-8
  CDS (1)..(48)
  Intron (49)..(173)
  CDS (174)..(836)

SEQ ID NO: 893 - protein, 237 aa, artificial sequence; identical to SEQ ID NO: 136
  Synthetic Construct

SEQ ID NO: 894 - DNA, 1629 bp, artificial sequence; identical to SEQ ID NO: 137
  full length heavy chain of antibody clone #8-8
  CDS (1)..(45)
  Intron (46)..(228)
  CDS (229)..(1626)

SEQ ID NO: 895 - protein, 481 aa, artificial sequence; identical to SEQ ID NO: 138
  Synthetic Construct

SEQ ID NO: 896 - DNA, 830 bp, artificial sequence; identical to SEQ ID NO: 139
  full length light chain of antibody clone #7
  CDS (1)..(48)
  Intron (49)..(173)
  CDS (174)..(827)
  misc_feature (228)..(228): n is a, c, g, or t
  misc_feature (232)..(233): n is a, c, g, or t

SEQ ID NO: 897 - protein, 234 aa, artificial sequence; identical to SEQ ID NO: 140
  misc_feature (35)..(35): The 'Xaa' at location 35 stands for Lys, Glu, or Gln.
  misc_feature (36)..(36): The 'Xaa' at location 36 stands for Lys, Asn, Arg, Ser, Thr, Ile, or Met.
  Synthetic Construct

SEQ ID NO: 898 - DNA, 1638 bp, artificial sequence; identical to SEQ ID NO: 141
  full length heavy chain of antibody clone #7
  CDS (1)..(45)
  Intron (49)..(228)
  CDS (229)..(1635)

SEQ ID NO: 899 - protein, 484 aa, artificial sequence; identical to SEQ ID NO: 142
  Synthetic Construct

SEQ ID NO: 900 - DNA, 833 bp, artificial sequence; identical to SEQ ID NO: 143
  full length light chain of antibody clone #10
  CDS (1)..(48)
  Intron (49)..(173)
  CDS (174)..(830)

SEQ ID NO: 901 - protein, 235 aa, artificial sequence; identical to SEQ ID NO: 144
  Synthetic Construct

SEQ ID NO: 902 - DNA, 1638 bp, artificial sequence; identical to SEQ ID NO: 145
  full length heavy chain of antibody clone #10
  CDS (1)..(45)
  Intron (46)..(228)
  CDS (229)..(1635)

SEQ ID NO: 903 - protein, 484 aa, artificial sequence; identical to SEQ ID NO: 146
  Synthetic Construct

SEQ ID NO: 904 - DNA, 833 bp, artificial sequence; identical to SEQ ID NO: 147
  full length light chain of antibody clone #13
  CDS (1)..(48)
  Intron (49)..(173)
  CDS (174)..(830)

SEQ ID NO: 905 - protein, 235 aa, artificial sequence; identical to SEQ ID NO: 148
  Synthetic Construct

SEQ ID NO: 906 - DNA, 1626 bp, artificial sequence; identical to SEQ ID NO: 121
  full length heavy chain of antibody clone #13
  CDS (1)..(45)
  Intron (46)..(228)
  CDS (229)..(1623)

SEQ ID NO: 907 - protein, 480 aa, artificial sequence; identical to SEQ ID NO: 122
  Synthetic Construct

SEQ ID NO: 908 - DNA, 839 bp, artificial sequence; identical to SEQ ID NO: 151
  full length light chain of antibody clone #22
  CDS (1)..(48)
  Intron (49)..(173)
  CDS (174)..(836)

SEQ ID NO: 909 - protein, 237 aa, artificial sequence; identical to SEQ ID NO: 152
  Synthetic Construct

SEQ ID NO: 910 - DNA, 1617 bp, artificial sequence; identical to SEQ ID NO: 153
  full length heavy chain of antibody clone #22
  CDS (1)..(45)
  Intron (46)..(228)
  CDS (229)..(1614)

SEQ ID NO: 911 - protein, 477 aa, artificial sequence; identical to SEQ ID NO: 154
  Synthetic Construct

SEQ ID NO: 912 - DNA, 833 bp, artificial sequence; identical to SEQ ID NO: 155
  full length light chain of antibody clone #33
  CDS (1)..(48)
  Intron (49)..(173)
  CDS (174)..(830)

SEQ ID NO: 913 - protein, 235 aa, artificial sequence; identical to SEQ ID NO: 156
  Synthetic Construct

SEQ ID NO: 914 - DNA, 1602 bp, artificial sequence; identical to SEQ ID NO: 157
  full length heavy chain of antibody clone #33
  CDS (1)..(45)
  Intron (46)..(228)
  CDS (229)..(1599)

SEQ ID NO: 915 - protein, 472 aa, artificial sequence; identical to SEQ ID NO: 158
  Synthetic Construct

SEQ ID NO: 916 - protein, 290 aa, artificial sequence; identical to SEQ ID NO: 159
  FSTL1 from Novoprotein

SEQ ID NO: 917 - DNA, 90 bp, artificial sequence; identical to SEQ ID NO: 160
  humanaizedH1-FR1
  CDS (1)..(90)

SEQ ID NO: 918 - protein, 30 aa, artificial sequence; identical to SEQ ID NO: 161
  Synthetic Construct

SEQ ID NO: 919 - DNA, 42 bp, artificial sequence; identical to SEQ ID NO: 162
  humanaizedH1-FR2
  CDS (1)..(42)

SEQ ID NO: 920 - protein, 14 aa, artificial sequence
  Synthetic Construct
WVRQAPGKGLEFVA

SEQ ID NO: 921 - DNA, 96 bp, artificial sequence; identical to SEQ ID NO: 164
  humanaizedH1-FR3
  CDS (1)..(96)

SEQ ID NO: 922 - protein, 32 aa, artificial sequence; identical to SEQ ID NO: 165
  Synthetic Construct

SEQ ID NO: 923 - DNA, 33 bp, artificial sequence; identical to SEQ ID NO: 166
  humanaizedH1-FR4
  CDS (1)..(33)

SEQ ID NO: 924 - protein, 11 aa, artificial sequence
  Synthetic Construct
WGQGTLVTVSS

SEQ ID NO: 925 - DNA, 90 bp, artificial sequence; identical to SEQ ID NO: 160
  humanaizedH2-FR1
  CDS (1)..(90)

SEQ ID NO: 926 - protein, 30 aa, artificial sequence; identical to SEQ ID NO: 161
  Synthetic Construct

SEQ ID NO: 927 - DNA, 42 bp, artificial sequence; identical to SEQ ID NO: 170
  humanaizedH2-FR2
  CDS (1)..(42)

SEQ ID NO: 928 - protein, 14 aa, artificial sequence
  Synthetic Construct
WVRQAPGKGLEFVS

SEQ ID NO: 929 - DNA, 96 bp, artificial sequence; identical to SEQ ID NO: 172
  humanaizedH2-FR3
  CDS (1)..(96)

SEQ ID NO: 930 - protein, 32 aa, artificial sequence; identical to SEQ ID NO: 173
  Synthetic Construct

SEQ ID NO: 931 - DNA, 33 bp, artificial sequence; identical to SEQ ID NO: 174
  humanaizedH2-FR4
  CDS (1)..(33)

SEQ ID NO: 932 - protein, 11 aa, artificial sequence
  Synthetic Construct
WGQGTLVTVSS

SEQ ID NO: 933 - DNA, 90 bp, artificial sequence; identical to SEQ ID NO: 160
  humanaizedH3-FR1
  CDS (1)..(90)

SEQ ID NO: 934 - protein, 30 aa, artificial sequence; identical to SEQ ID NO: 161
  Synthetic Construct

SEQ ID NO: 935 - DNA, 42 bp, artificial sequence; identical to SEQ ID NO: 162
  humanaizedH3-FR2
  CDS (1)..(42)

SEQ ID NO: 936 - protein, 14 aa, artificial sequence
  Synthetic Construct
WVRQAPGKGLEFVA

SEQ ID NO: 937 - DNA, 96 bp, artificial sequence; identical to SEQ ID NO: 180
  humanaizedH3-FR3
  CDS (1)..(96)

SEQ ID NO: 938 - protein, 32 aa, artificial sequence; identical to SEQ ID NO: 181
  Synthetic Construct

SEQ ID NO: 939 - DNA, 33 bp, artificial sequence; identical to SEQ ID NO: 166
  humanaizedH3-FR4
  CDS (1)..(33)

SEQ ID NO: 940 - protein, 11 aa, artificial sequence
  Synthetic Construct
WGQGTLVTVSS

SEQ ID NO: 941 - DNA, 66 bp, artificial sequence; identical to SEQ ID NO: 184
  humanaizedL1-FR1
  CDS (1)..(66)

SEQ ID NO: 942 - protein, 22 aa, artificial sequence
  Synthetic Construct
SYELTQPPSVSVSPGQTARITC

SEQ ID NO: 943 - DNA, 45 bp, artificial sequence; identical to SEQ ID NO: 186
  humanaizedL1-FR2
  CDS (1)..(45)

SEQ ID NO: 944 - protein, 15 aa, artificial sequence
  Synthetic Construct
WYQQKPGQAPVTVIY

SEQ ID NO: 945 - DNA, 96 bp, artificial sequence; identical to SEQ ID NO: 188
  humanaizedL1-FR3
  CDS (1)..(96)

SEQ ID NO: 946 - protein, 32 aa, artificial sequence; identical to SEQ ID NO: 189
  Synthetic Construct

SEQ ID NO: 947 - DNA, 30 bp, artificial sequence; identical to SEQ ID NO: 190
  humanaizedL1-FR4
  CDS (1)..(30)

SEQ ID NO: 948 - protein, 10 aa, artificial sequence
  Synthetic Construct
FGGGTKLTVL

SEQ ID NO: 949 - DNA, 1425 bp, artificial sequence; identical to SEQ ID NO: 192
  humanized-IgG1-H1-complete
  CDS (1)..(1425)
  sig_peptide (1)..(54)

SEQ ID NO: 950 - protein, 474 aa, artificial sequence; identical to SEQ ID NO: 193
  Synthetic Construct

SEQ ID NO: 951 - DNA, 1425 bp, artificial sequence; identical to SEQ ID NO: 194
  humanized-IgG1-H2-complete
  CDS (1)..(1425)
  sig_peptide (1)..(54)

SEQ ID NO: 952 - protein, 474 aa, artificial sequence; identical to SEQ ID NO: 195
  Synthetic Construct

SEQ ID NO: 953 - DNA, 1425 bp, artificial sequence; identical to SEQ ID NO: 196
  humanized-IgG1-H3-complete
  CDS (1)..(1425)
  sig_peptide (1)..(54)

SEQ ID NO: 954 - protein, 474 aa, artificial sequence; identical to SEQ ID NO: 197
  Synthetic Construct

SEQ ID NO: 955 - DNA, 1416 bp, artificial sequence; identical to SEQ ID NO: 198
  humanized-IgG4-H1-complete
  CDS (1)..(1416)
  sig_peptide (1)..(54)

SEQ ID NO: 956 - protein, 471 aa, artificial sequence; identical to SEQ ID NO: 199
  Synthetic Construct

SEQ ID NO: 957 - DNA, 1416 bp, artificial sequence; identical to SEQ ID NO: 200
  humanized-IgG4-H2-complete
  CDS (1)..(1416)
  sig_peptide (1)..(54)

SEQ ID NO: 958 - protein, 471 aa, artificial sequence; identical to SEQ ID NO: 201
  Synthetic Construct

SEQ ID NO: 959 - DNA, 1416 bp, artificial sequence; identical to SEQ ID NO: 202
  humanized-IgG4-H3-complete
  CDS (1)..(1416)
  sig_peptide (1)..(54)

SEQ ID NO: 960 - protein, 471 aa, artificial sequence; identical to SEQ ID NO: 203
  Synthetic Construct

SEQ ID NO: 961 - DNA, 693 bp, artificial sequence; identical to SEQ ID NO: 204
  humanized-L1-complete
  CDS (1)..(693)
  sig_peptide (1)..(54)

SEQ ID NO: 962 - protein, 230 aa, artificial sequence; identical to SEQ ID NO: 205
  Synthetic Construct

SEQ ID NO: 963 - protein, 30 aa, artificial sequence; identical to SEQ ID NO: 206
  chicken-Heavy-FR1-for-reference

SEQ ID NO: 964 - protein, 14 aa, artificial sequence
  chicken-Heavy-FR2-for-reference
WVRQAPGKGLEWVA

SEQ ID NO: 965 - protein, 32 aa, artificial sequence; identical to SEQ ID NO: 208
  chicken-Heavy-FR3-for-reference

SEQ ID NO: 966 - protein, 11 aa, artificial sequence
  chicken-Heavy-FR4-for-reference
WGHGTEVIVSP

SEQ ID NO: 967 - protein, 20 aa, artificial sequence
  chicken-Light-FR1-for-reference
ASTQPSSVSANPGETVKITC

SEQ ID NO: 968 - protein, 16 aa, artificial sequence
  chicken-Light-FR2-for-reference
WYQQKSPGSAPVTVIY

SEQ ID NO: 969 - protein, 32 aa, artificial sequence; identical to SEQ ID NO: 212
  chicken-Light-FR3-for-reference

SEQ ID NO: 970 - protein, 10 aa, artificial sequence
  chicken-Light-FR4-for-reference
FGAGTTLTVL

SEQ ID NO: 971 - protein, 16 aa, artificial sequence
  chicken-alternative-Light-FR2-for-reference
WYQQKSPGSAPVTVIY

SEQ ID NO: 972 - protein, 10 aa, artificial sequence
  chicken-alternative-Light-FR3-for-reference
FGAGTTLTVL

SEQ ID NO: 973 - DNA, 21 bp, artificial sequence
  delta 193-204 (Forward primer)
agcgacgagaacgccgactgg

SEQ ID NO: 974 - DNA, 25 bp, artificial sequence
  delta 193-204 (Reverse primer)
cagcttgttgttttcctggtcgggg

SEQ ID NO: 975 - DNA, 21 bp, artificial sequence
  delta 205-216 (Forward primer)
gaatttctgaagtgcctgaac

SEQ ID NO: 976 - DNA, 21 bp, artificial sequence
  delta 205-216 (Reverse primer)
cagctcaatcagggcgtccac

SEQ ID NO: 977 - DNA, 25 bp, artificial sequence
  delta 217-228 (Forward primer)
cccgagaagaagtgcgccctggagg

SEQ ID NO: 978 - DNA, 21 bp, artificial sequence
  delta 217-228 (Reverse primer)
ctgaaagctcagcttccagtc

SEQ ID NO: 979 - DNA, 21 bp, artificial sequence
  delta 233-251 (Forward primer)
agatgcgtgtgcgcctgcggc

SEQ ID NO: 980 - DNA, 25 bp, artificial sequence
  delta 233-251 (Reverse primer)
cttcttctcgggggggttgaagctg

SEQ ID NO: 981 - DNA, 21 bp, artificial sequence
  delta 252-270 (Forward primer)
aatcagaagggcgcccagacc

SEQ ID NO: 982 - DNA, 22 bp, artificial sequence
  delta 252-270 (Reverse primer)
gttgcagtccacctctgtctcg

SEQ ID NO: 983 - DNA, 25 bp, artificial sequence
  delta 271-289 (Forward primer)
cttcttctcgggggggttgaagctg

SEQ ID NO: 984 - DNA, 22 bp, artificial sequence
  delta 271-289 (Reverse primer)
cttgccgtcgcaggtcatggcg

SEQ ID NO: 985 - DNA, 21 bp, artificial sequence
  delta 48-100 (Forward primer)
aagaaaagcgtgtcccccagc

SEQ ID NO: 986 - DNA, 21 bp, artificial sequence
  delta 48-100 (Reverse primer)
cttctcggtcacggcacattc

SEQ ID NO: 987 - DNA, 66 bp, artificial sequence; identical to SEQ ID NO: 184
  humanizedL2-FR1
  CDS (1)..(66)

SEQ ID NO: 988 - protein, 22 aa, artificial sequence
  Synthetic Construct
SYELTQPPSVSVSPGQTARITC

SEQ ID NO: 989 - DNA, 45 bp, artificial sequence; identical to SEQ ID NO: 186
  humanizedL2-FR2
  CDS (1)..(45)

SEQ ID NO: 990 - protein, 15 aa, artificial sequence
  Synthetic Construct
WYQQKPGQAPVTVIY

SEQ ID NO: 991 - DNA, 96 bp, artificial sequence; identical to SEQ ID NO: 234
  humanizedL2-FR3
  CDS (1)..(96)

SEQ ID NO: 992 - protein, 32 aa, artificial sequence; identical to SEQ ID NO: 235
  Synthetic Construct

SEQ ID NO: 993 - DNA, 30 bp, artificial sequence; identical to SEQ ID NO: 190
  humanizedL2-FR4
  CDS (1)..(30)

SEQ ID NO: 994 - protein, 10 aa, artificial sequence
  Synthetic Construct
FGGGTKLTVL

SEQ ID NO: 995 - DNA, 66 bp, artificial sequence; identical to SEQ ID NO: 184
  humanizedL3-FR1
  CDS (1)..(66)

SEQ ID NO: 996 - protein, 22 aa, artificial sequence
  Synthetic Construct
SYELTQPPSVSVSPGQTARITC

SEQ ID NO: 997 - DNA, 45 bp, artificial sequence; identical to SEQ ID NO: 186
  humanizedL3-FR2
  CDS (1)..(45)

SEQ ID NO: 998 - protein, 15 aa, artificial sequence
  Synthetic Construct
WYQQKPGQAPVTVIY

SEQ ID NO: 999 - DNA, 96 bp, artificial sequence; identical to SEQ ID NO: 242
  humanizedL3-FR3
  CDS (1)..(96)

SEQ ID NO: 1000 - protein, 32 aa, artificial sequence; identical to SEQ ID NO: 243
  Synthetic Construct

SEQ ID NO: 1001 - DNA, 30 bp, artificial sequence; identical to SEQ ID NO: 190
  humanizedL3-FR4
  CDS (1)..(30)

SEQ ID NO: 1002 - protein, 10 aa, artificial sequence
  Synthetic Construct
FGGGTKLTVL

SEQ ID NO: 1003 - DNA, 693 bp, artificial sequence; identical to SEQ ID NO: 246
  humanizedL2-complete
  CDS (1)..(693)
  sig_peptide (1)..(54)

SEQ ID NO: 1004 - protein, 230 aa, artificial sequence; identical to SEQ ID NO: 247
  Synthetic Construct

SEQ ID NO: 1005 - DNA, 693 bp, artificial sequence; identical to SEQ ID NO: 248
  humanizedL3-complete
  CDS (1)..(693)
  sig_peptide (1)..(54)

SEQ ID NO: 1006 - protein, 230 aa, artificial sequence; identical to SEQ ID NO: 249
  Synthetic Construct

SEQ ID NO: 1007 - DNA, 1419 bp, artificial sequence
  heavy chain of humanaized antibody
atgatgtcctttgtctctctgctcctggttggcatcctattccatgccacccaggccgaggtgcagctgttggagtctgggggaggactggtgcagcctggcggaagcctgagactgtcttgtgccgccagcggcttcaccttcagcagcgtgacaatgcagtgggtgcgccaggcccctggcaagggactggaatttgtgtccagcgtgtgcagcggcagcagcacctattatgcccctgccgtgaagggccggttcaccatctcccgggacaacagcaagaacaccgtgtacctgcagatgaacagcctgcgggccgaggacaccgccgtgtactactgtgccaagatcgccggcagagcccggtggtcttgtaccagcgccgcctacaacatcgacgcctggggacagggaaccctcgtgacagtgtctagcgccagcaccaagggccccagcgtgttccctctggccccttgtagcagaagcaccagcgagtctacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgactgtgcccagcagctctctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcctagagaggaacagttcaacagcacctaccgggtggtgtccgtgctgacagtgctgcatcaggactggctgaacggcaaagagtacaagtgcaaggtgtccaacaagggcctgcccagctccatcgagaaaaccatcagcaaggccaagggccagccccgcgaaccccaggtgtacacactgcctccaagccaggaagagatgaccaagaaccaggtgtccctgacctgtctcgtgaaaggcttctacccctccgatatcgccgtggaatgggagagcaacggccagcccgagaacaactacaagacaaccccccctgtgctggacagcgacggctcattcttcctgtacagcagactgaccgtggacaagagccggtggcaggaaggcaacgtgttcagctgcagcgtgatgcacgaggccctgcacaaccactacacccagaagtccctgtctctgagcctgggcaagtga

SEQ ID NO: 1008 - protein, 472 aa, artificial sequence
  heavy chain of humanaized antibody
MMSFVSLLLVGILFHATQAEVQLLESGGGLVQPGGSLRLSCAASGFTFSSVTMQWVRQAPGKGLEFVSSVCSGSSTYYAPAVKGRFTISRDNSKNTVYLQMNSLRAEDTAVYYCAKIAGRARWSCTSAAYNIDAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1009 - DNA, 693 bp, artificial sequence
  light chain of humanaized antibody
atgatgtcctttgtctctctgctcctggttggcatcctattccatgccacccaggccagctatgagctgactcagccacccagcgtgtccgtgtctcctggccagaccgccagaatcacctgtagcggcggaggcaacaactacggctggtatcagcagaagcccggccaggcccctgtgaccgtgatctactacaacgacaaccggcccagcggcatccccgagagattcagcggcagcaatagcggctccaccaccaccctgacaatcagcggagtgcaggccgaggacgaggccgattactactgcggcagctgggacagcaacaccgactccggcatctttggcggcggaaccaagctgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 1010 - protein, 230 aa, artificial sequence
  light chain of humanaized antibody
MMSFVSLLLVGILFHATQASYELTQPPSVSVSPGQTARITCSGGGNNYGWYQQKPGQAPVTVIYYNDNRPSGIPERFSGSNSGSTTTLTISGVQAEDEADYYCGSWDSNTDSGIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

The invention claimed is:

1. An anti-FSTL1 antibody comprising the heavy chain CDR1, heavy chain CDR2, heavy chain CDR3, light chain CDR1, light chain CDR2, and light chain CDR3 of an antibody selected from the group consisting of antibody #5-2 (light chain: SEQ ID NO: 6; heavy chain: SEQ ID NO: 8), antibody #5-3 (light chain: SEQ ID NO: 10; heavy chain: SEQ ID NO: 12), antibody #5-8 (light chain: SEQ ID NO: 14; heavy chain: SEQ ID NO: 16), antibody #5-10 (light chain: SEQ ID NO: 18; heavy chain: SEQ ID NO: 20), antibody #5-43 (light chain: SEQ ID NO: 22; heavy chain: SEQ ID NO: 24), antibody #6-55 (light chain: SEQ ID NO: 26; heavy chain: SEQ ID NO: 28), antibody #7-34 (light chain: SEQ ID NO: 30; heavy chain: SEQ ID NO: 32), antibody #8-1 (light chain: SEQ ID NO: 34; heavy chain: SEQ ID NO: 36), antibody #8-4 (light chain: SEQ ID NO: 38; heavy chain: SEQ ID NO: 40), antibody #8-7 (light chain: SEQ ID NO: 42; heavy chain: SEQ ID NO: 44), antibody #8-8 (light chain: SEQ ID NO: 46; heavy chain: SEQ ID NO: 48), antibody #7 (light chain: SEQ ID NO: 50; heavy chain: SEQ ID NO: 52), antibody #10 (light chain: SEQ ID NO: 54; heavy chain: SEQ ID NO: 56), antibody #13 (light chain: SEQ ID NO: 58; heavy chain: SEQ ID NO: 60), antibody #22 (light chain: SEQ ID NO: 62; heavy chain: SEQ ID NO: 64) and antibody #33 (light chain: SEQ ID NO: 66; heavy chain: SEQ ID NO: 68), wherein the antibody recognizes an epitope in a region selected from the group consisting of amino acid positions 48 to 100, 148 to 162, 193 to 216, 205 to 228, and 272 to 289 of SEQ ID NO: 1 (amino acid sequence of human FSTL1).

2. The anti-FSTL1 antibody of claim 1, wherein the antibody comprises the full-length variable regions of an antibody selected from the group consisting of antibody #5-2 (light chain: SEQ ID NO: 6; heavy chain: SEQ ID NO: 8), antibody #5-3 (light chain: SEQ ID NO: 10; heavy chain: SEQ ID NO: 12), antibody #5-8 (light chain: SEQ ID NO: 14; heavy chain: SEQ ID NO: 16), antibody #5-10 (light chain: SEQ ID NO: 18; heavy chain: SEQ ID NO: 20), antibody #5-43 (light chain: SEQ ID NO: 22; heavy chain: SEQ ID NO: 24), antibody #6-55 (light chain: SEQ ID NO: 26; heavy chain: SEQ ID NO: 28), antibody #7-34 (light chain: SEQ ID NO: 30; heavy chain: SEQ ID NO: 32), antibody #8-1 (light chain: SEQ ID NO: 34; heavy chain: SEQ ID NO: 36), antibody #8-4 (light chain: SEQ ID NO: 38; heavy chain: SEQ ID NO: 40), antibody #8-7 (light chain: SEQ ID NO: 42; heavy chain: SEQ ID NO: 44), antibody #8-8 (light chain: SEQ ID NO: 46; heavy chain: SEQ ID NO: 48), antibody #7 (light chain: SEQ ID NO: 50; heavy chain: SEQ ID NO: 52), antibody #10 (light chain: SEQ ID NO: 54; heavy chain: SEQ ID NO: 56), antibody #13 (light chain: SEQ ID NO: 58; heavy chain: SEQ ID NO: 60), antibody #22 (light chain: SEQ ID NO: 62; heavy chain: SEQ ID NO: 64), and antibody #33 (light chain: SEQ ID NO: 66; heavy chain: SEQ ID NO: 68).

3. The anti-FSTL1 antibody of claim 1, or the fragment or functional equivalent thereof according to claim H7, wherein the antibody comprises a full-length antibody selected from the group consisting of antibody #5-2 (light chain: SEQ ID NO: 96; heavy chain: SEQ ID NO: 98), antibody #5-3 (light chain: SEQ ID NO: 100; heavy chain: SEQ ID NO: 102), antibody #5-8 (light chain: SEQ ID NO: 104; heavy chain: SEQ ID NO: 106), antibody #5-10 (light chain: SEQ ID NO: 108; heavy chain: SEQ ID NO: 110), antibody #5-43 (light chain: SEQ ID NO: 112; heavy chain: SEQ ID NO: 114), antibody #6-55 (light chain: SEQ ID NO: 116; heavy chain: SEQ ID NO: 118), antibody #7-34 (light chain: SEQ ID NO: 120; heavy chain: SEQ ID NO: 122), antibody #8-1 (light chain: SEQ ID NO: 124; heavy chain: SEQ ID NO: 126), antibody #8-4 (light chain: SEQ ID NO: 128; heavy chain: SEQ ID NO: 130), antibody #8-7 (light chain: SEQ ID NO: 132; heavy chain: SEQ ID NO: 134), antibody #8-8 (light chain: SEQ ID NO: 136; heavy chain: SEQ ID NO: 138), antibody #7 (light chain: SEQ ID NO: 140; heavy chain: SEQ ID NO: 142), antibody #10 (light chain: SEQ ID NO: 144; heavy chain: SEQ ID NO: 146), antibody #13 (light chain: SEQ ID NO: 148; heavy chain: SEQ ID NO: 150), antibody #22 (light chain: SEQ ID NO: 152; heavy chain: SEQ ID NO: 154) and antibody #33 (light chain: SEQ ID NO: 156; heavy chain: SEQ ID NO: 158); or a humanized sequence thereof.

4. The anti-FSTL1 antibody of claim 1, wherein the antibody is a humanized antibody.

5. The anti-FSTL1 antibody of claim 4, wherein the humanized antibody has a heavy chain framework sequence comprising SEQ ID NOs: 161, 163, 165, and 167 (humanized heavy chain sequence FR1, FR2, FR3, and FR4 of H(1)), SEQ ID NOs: 169, 171, 173, and 175 (humanized heavy chain sequence FR1, FR2, FR3, and FR4 of H(2)), or SEQ ID NOs: 177, 179, 181, and 183 (humanized heavy chain sequence FR1, FR2, FR3, and FR4 of H(3)), and a light chain framework sequence comprising SEQ ID NOs: 185, 187, 189, and 191 (humanized light chain sequence FR1, FR2, FR3, and FR4 of L(1)), SEQ ID NOs: 231, 233, 235, and 237 (humanized light chain sequence FR1, FR2, FR3, and FR4 of L(2)), or SEQ ID NOs: 239, 241, 243, and 245 (humanized light chain sequence FR1, FR2, FR3, and FR4 of L(3)), or sequences obtained by the mutation (back mutation) of one or more differing amino acids in each of these heavy chain and light chain framework sequences from heavy chain sequence FR1, FR2, FR3, and FR4 (SEQ ID NOs: 206, 207, 208, and 209) and light chain sequence FR1, FR2, FR3, and FR4 (SEQ ID NOs: 210, 211 or 214, 212 or 215, and 213) of corresponding chicken sequences, into amino acids in each of the chicken sequences.

6. The anti-FSTL1 antibody of claim 1, wherein the antibody is a humanized antibody having the H chain FR1, FR2, FR3, and FR4 (SEQ ID NOs: 169, 171, 173, and 175, respectively) and L chain FR1, FR2, FR3 and FR4 (SEQ ID NOs: 185, 187, 189, and 191, respectively) of H(2)-L(1).

7. The anti-FSTL1 antibody of claim 1 as an agent selected from the group consisting of the following (i) to (vi):
  (i) an anticancer agent,
  (ii) a therapeutic agent for metastatic malignant tumor,
  (iii) a therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, pancreatic cancer, bladder cancer, uterine cervical cancer, brain central nervous system tumor, sarcoma, leukemia, and multiple myeloma,
  (iv) an inhibitor of metastasis of cancer cells,
  (v) an inhibitor of enhancement of immune defect by mesenchymal stem cells (MSCs), and
  (vi) an inhibitor of acquirement and/or enhancement of immune defect activity by or of immune-related cells.

8. A combination product of an anti-FSTL1 antibody of claim 1 and additional cancer treatment.

9. The combination product according to claim 8, wherein the additional cancer treatment includes a different anticancer agent or radiation therapy, or both.

10. The combination product according to claim 8, wherein the different anticancer agent is (1) a PD-L1 suppressor, (2) a CTLA4 suppressor, or (3) a chemotherapeutic agent.

11. The combination product according to claim 8, wherein the additional cancer treatment is at least one selected from cancer immunotherapy, molecular targeting therapy, and chemotherapy.

12. The combination product according to claim 11, wherein the cancer immunotherapy is at least one selected from administration of a drug for mitigation of immunosuppression, administration of a cancer vaccine, and immune cell therapy.

13. The combination product according to claim 12, wherein the drug for mitigation of immunosuppression is at least one selected from a PD-L1 suppressor, a CTLA4 suppressor, a PD-1 suppressor, a 4-1BB suppressor, a 4-1BB promoter, a OX40 promoter, a GITR suppressor, a CD27 suppressor, a CD40 promoter, a LAG3 suppressor, a B7-H3 suppressor, a KIRs suppressor, a NKG2A suppressor, a CSF1R suppressor, an IDO suppressor, a TGFβ suppressor, a CXCR4 suppressor, a phosphatidylserine suppressor, a CD47 suppressor, a VEGF suppressor, and neuropilin suppressor.

14. The combination product according to claim 12, wherein the immune cell therapy is at least one selected from chimeric antigen receptor T cell therapy, dendritic cell therapy, and activated lymphocyte therapy.

15. The combination product according to claim 11, wherein a molecular targeting drug for use in the molecular targeting therapy is at least one selected from an anti-CD20 antibody, an anti-HER2 antibody, an anti-HER3 antibody, an anti-EGFR antibody, an anti-VEGF antibody, an anti-CD33 antibody (calicheamicin-conjugated), an anti-CD52 antibody, an anti-CD19/CD3 antibody, an anti-RANKL antibody, an anti-CD30 antibody, an anti-CCR4 antibody, an anti-folate receptor antibody, an anti-glypican antibody, an anti-CD26 antibody, an anti-IGF antibody, an anti-B7-H3 antibody, an anti-EPHA antibody, an anti-IGFR1 antibody, an anti-GD2 (ganglioside) antibody, an anti-EDb (fibronectin) antibody, an anti-CS1 antibody, an anti-VEGFR-2 antibody, an anti-CD4 antibody, an anti-Met antibody, an anti-CD22 antibody, an anti-G250 antibody, an anti-integrin (CD51) antibody, an anti-integrin av antibody, an anti-hepatocyte growth factor/scatter factor antibody, an anti-PDGFRa antibody, an anti-HGF (hepatocyto growth factor) antibody, an anti-PLGF (placental growth factor) antibody, an anti-c-Met antibody, an anti-myostatin antibody, an anti-EpCAM (CD326) antibody, an anti-EGFL7 (epidermal growth factor domain-like 7) antibody, an anti-EGFR/HER3 bispecific antibody, an anti-LOXL2 (lysyl oxidase-like-2) antibody, an anti-TRAIL R1 antibody, an anti-CD56 antibody, an anti-CD22 antibody, an anti-IL-6 antibody, an anti-GD3 antibody, an anti-FAP (fibroblast activation protein) antibody, an anti-CD221 (insulin-like growth factor 1 receptor) antibody, an anti-CD19/T cell bispecific antibody, an anti-DKK-1 (Dickkopf-1) antibody, an anti-DNA histone complex antibody, an anti-phosphatidyl serine antibody, an anti-angiopoietin-2 antibody, an anti-RI (131I) antibody, an anti-IL-2 antibody, an anti-TNF-α antibody, an anti-CD105 antibody, an anti-IL-1α antibody, an anti-PSCA antibody, an anti-mesothelin antibody, an anti-TEM-1 antibody, an anti-GPNMB antibody, an anti-DR5 antibody, an anti-TF-VIIa antibody, an anti-CD200 (OX-2) antibody, an anti-CD138 antibody, an anti-CD20/CD3 bispecific antibody, an anti-IL-13 antibody, an anti-CD38 antibody, an anti-hPAM4 antibody, an anti-CD74 antibody, an anti-MUC5AC antibody, and an anti-CD40 antibody.

16. The combination product according to claim 11, wherein a chemotherapeutic agent for use in the chemotherapy is at least one selected from the group consisting of an alkylating agent, a nitrosourea agent, an antimetabolite, an anticancer antibiotic, a plant-derived alkaloid, a topoisomerase inhibitor, a hormone therapeutic agent, a hormone antagonist, an aromatase inhibitor, a P glycoprotein inhibitor, and a platinum complex derivative.

17. The combination product according to claim 8 as an agent selected from the group consisting of the following (i) to (v):
  (i) an anticancer agent
  (ii) a therapeutic agent for at least one disease selected from the group consisting of melanoma, colorectal cancer, breast cancer, lymphoma, lung cancer, prostate cancer, kidney cancer, head and neck cancer, esophageal cancer, stomach cancer, pancreatic cancer, bladder cancer, uterine cervical cancer, brain central nervous system tumor, sarcoma, leukemia, and multiple myeloma,
  (iii) an inhibitor of metastasis of cancer cells,
  (iv) an inhibitor of enhancement of immune defect by mesenchymal stem cells (MSCs), and
  (v) an inhibitor of acquirement and/or enhancement of immune defect activity by or of immune-related cells.

18. A medicament for combined use with (1) a PD-L1 suppressor, (2) a CTLA4 suppressor, or (3) a chemotherapeutic agent, comprising an anti-FSTL1 antibody claim 1 as an active ingredient.

19. A medicament for combined use with at least one drug for mitigation of immunosuppression selected from a PD-L1 suppressor, a CTLA4 suppressor, a PD-1 suppressor, a 4-1BB suppressor, a 4-1BB promoter, an OX40 promoter, a GITR suppressor, a CD27 suppressor, a CD40 promoter, a LAG3 suppressor, a B7-H3 suppressor, a KIRs suppressor, a NKG2A suppressor, a CSF1R suppressor, an IDO suppressor, a TGFβ suppressor, a CXCR4 suppressor, a phosphatidylserine suppressor, a CD47 suppressor, a VEGF suppressor, and a neuropilin suppressor, comprising an anti-FSTL1 antibody of claim 1 as an active ingredient.

* * * * *